United States Patent 9,371,534 (METHOD FOR PRODUCING EXPRESSION PRODUCT OF EXOGENOUS GENE IN YEAST, REGULATOR OF EXPRESSION IN YEAST, AND USE THEREOF) - sequence listing, part 2

SEQ ID NO: 13938 - DNA, 490 bp, Saccharomyces cerevisiae
tggttgccgctaatcatatgtaaaatataaataggagagaaaacatatatagctatggaaagtattaaatgtttttttgctgtttttatattttcccccttggggactgtgagttcatcatatatgcatatttgctacttggaatgtagcccttcctagttacaggggtatgcggcgagttattgtcattgttagcgctcactaatgtgctactgataccgctatgcctctgcagtgtgccaaatacattctttgtgtgtaaggattgagattgtagtttcgtctgttcctccgccatttccctttgtcttgctttcaaaggcgtctctaagcctttgaagagatatgctggatgatttttgagatttgtttgaggaatatgtgttttgttctgtgccatttggctgatcttagaagtggatacgtagtgggggtgttgtggctgcaacccagtatcgacagatgattgcatgtctacccccaggagctt

SEQ ID NO: 13939 - DNA, 453 bp, Saccharomyces cerevisiae
aaataaaacaaataggaatgttgacatttatatttcattttctttctattgtatactccaatacataaacatattatatatacgtacataatgtaataacactaatctaaaataatggcatcgtcgacagcatccaaggctttctcctcttgagtctccacagatgcaggtgcttccattttgggagtcaaaaacaattgcttaacgataaattccacgccgttgatgacattcatcaatgcccaaacccagattcccaaagagacactctgtaaagccatatcatcaaacttggaagcaccaaatttgccctccattatatgccatttctgagaaatagtccttagaggatgcaagagaacatataaccagccttgagaccaaacaccacttacaaacgtagggaacaaggtgctagtcgaggaactcaacttgtaaactggtgtcttgccg

SEQ ID NO: 13940 - DNA, 497 bp, Saccharomyces cerevisiae
tgatagcaccggagggagcccaggcaagaataatgggagaaggaaggaacatatatacgtatgtctttttttagtactattattactgttattattatgagtattgtttttgtattaccatcatattcttatcattattagtagtaacagtattatgttatcattactgttataatgaatacaaattatgaaaaaaataaggtaaagccaaaataaattgtaacttttttatgccatttcacttcgaattatgtataaaagccgtattctttgccagtacgaaactattttaatgacacctttactttaaccgggtaacaacttccttaaatgggtcgacaaggtttttagagtataaaggggcaagtgaaggttcatcatcgagctgatgtagtgggtgttttagtaaacgaagaagcaccttagaaccaaataatctagctagtataaaccgaacccagagtagcaaacaaaccatgggtaatgttccagggaaa

SEQ ID NO: 13941 - DNA, 420 bp, Saccharomyces cerevisiae
gatgattgatcatgaattgtactttttatatataaagataaacgttaatataaatatatttatttgaagacgtcttttacgtttttctgtatctgattggtatatgcgttctcgtccggggacattttttctttttttggtgcggcgaatggaaataatcgcgataatgaatatgcaaggaacaaagaacagacaccccacccttattatcatatcacatctctgtaggagtctaccattttgcttctattgtaatctttgcgactttatttcaactcaccattcatacaaaatttctactgccgtttaaaataaggaaagcataaagattaaagcaaattaagaggaaccctttttttttttgatttcgatacaatggcattttggttacctcaaaatatacaaaagcggctgcttctt

SEQ ID NO: 13942 - DNA, 402 bp, Saccharomyces cerevisiae
catcactgtatgatctcattctttctgcaattattgcacgcctcctcgtgagtagtgaccgtgcgaacaaaagagtcattacaacgaggaaatagaagaaaatgaaaaattttcgacaaaatgtatagtcatttctatcaataacgtatacacgtttttttaatactatctatattgtgtatcttatatttttccatttggtagtatagcagcaaatatttgttcttagacggccaccatccctcacaccaatgcctaacgcttcccaagtttacagatctaccagatccagctctccaaagacaatctcttttgaagaggctatcattcaaggtctggccactgacggtggtcttttcattccaccaactattccacaagtggaccaagccactcttttca

SEQ ID NO: 13943 - DNA, 472 bp, Saccharomyces cerevisiae
aatcaatcaatttatatctgagaaagattctacacacagatatatatatatatatatatattattgtatatatacatacctacattatttttaaaggcttgcatgatgctgttatgtaaaaaaaaaaaaaaaaaatcagtgtaacataatagacgtaacacgttcaatgacatgataatactatatatagtaacgataaaatgtaaatggtaatagatataattatatgaatatttaagtaatgcattgataagtgatcaattcatatcagggttggatagctttttcaattcttccagcctatcaattagttttttacggcgtgtaacgggggcatgagcaaatctcttggataattcataatccgtggagcaggttgacgtagcatcgtacatagtattatttgtggcagataatgtgttatgatatgctgagacgttttgaactcgttccactggggtattattcgcgt

SEQ ID NO: 13944 - DNA, 449 bp, Saccharomyces cerevisiae
gagaacccgcaaaagtattcaagaatgaaaaaaaaaaaaagaataatctccccttctgttctttgcagttgcctttcttcccctcagtgttattttttttcacaaggagataaaaaaaaaaactttaacatgtcactttaagcatgtatgtaatacgtctattaattatatgtaacttttataactattttcatttctatgtgatccatttgcagttatgcaccttttttttttttccgaattgtgctatgtatatatcactagtaataatgtaccaaactatacaaacacgtaggatacagtaaaaaaaattttagctggtgaactgttgtaagaaggagatttcatcgggcgtgaaatttattgcagaaatttgggcagaatggttcatcaaaaaggtgtagatctcttgcgcaaaaacattcgcctctacattgcttgaaaggccc

SEQ ID NO: 13945 - DNA, 480 bp, Saccharomyces cerevisiae
aagagaaggtaacaagcacataaaaaatcagcacatacgtacatacataagaatgaatcgcacgcacgcgtaaacatttatcatttaatcttcagttgttagataaaaaaaaaaagaaaagaaaagaaagtgaaggcttgtttcagtttgaactaggtagcagagcaagccctcgttcttggctgctaattttcctaaagtagtaaaaaaagccaagttatctgcctacggttgtcacagcaacattgcgtgccgttgttcttttgtttttttttttttttttttttcgtggttgtcgcagcaacgacacctaggcgctgctcaaaggggcaaaaacccggttgccatggcgaggaccaaacgacaagatgggaaaaaaacaatagtctattgttaaatcgtaatactgtattgtgagatgctgacgcgtttcgtttttcgtgtcagcgttctttatattgtttcgtgttctgctgcaaa

SEQ ID NO: 13946 - DNA, 450 bp, Saccharomyces cerevisiae
aaatgatcctgctctcttgatatgacatggttttgattgcaagtctattcttacttgttcaattggtttcaccagcatctttttgtatccattttcctatgctgtgtatctagtaaaagagttgcttgccaccaaacattaatactaatggttaatctgccaccttttgtaagctttctataatgtacaattgtaatatgttcttttattctcgtacaaagtatatatactatacacatacaagcatgcatgcaagcacgccggcaaacccttcctcaatttataaaatgtaaacaaacgaaatgtaaaatcaaactagcaacaataaactcggcaaaagctctgtttttagaaatgcctggaaaactattacacaattgtaaccgcaaactcatcaataggacgaattgtcccacacaaataatgaatcccgctaaaaacgcattgaat

SEQ ID NO: 13947 - DNA, 496 bp, Saccharomyces cerevisiae
attaaactaagtaagcatgactcaaattttctggaatactttgaaaatcaacgtcctacattctatcaaatatcatatatatgcgcacaattacgttcttcagcaatcagttagacctgaagaaaaaagtaagggtagaaaaagtatataaatatataaaagtgtaaaaataaaaaatacaatgtggttgtgtgaaatttattgacctcgcctgttcctaactaccaacgtattgaactattaaaaccattaccgaaagcgctattatcaccaacattggaaaaattaacgttagctttgtcacttttgaactcgttaaacgagctaccattcccatctccctccttcattgactttgttgccatcgataacggtggtgacataaattccatcaaactaatatcacgacctttgttatcgttcccatcggtgcgaccagcattgctaccaccattagtattaacagaaatattgttattactgggagtacgcgacg

SEQ ID NO: 13948 - DNA, 488 bp, Saccharomyces cerevisiae
tgtccttaagagcacacgttttaattagcaacctttgctgttgcttttgttcaagctattagattatgtaaacagatatatattatgtaagtgtgacaggatacgacagcactaactgtcagcgaattttgatttgttacttttgctagttttgtgtgactttcctttgttttttaactttttttttcagatttgtattatgagatgataacaatgcgagatttcattgacaagttcgataaaacaatagaagcttccattttatacatatgtgataaaacaacctgcaatcgaggatttacaataaaagtctctttgagaggattgagaaatagtgcaaaaagatctactaataacgaatagttatgactgttactgacacttttaaactgtttattttaaggcatggtcaaagtgaattaaactcagaaaacatattctgcggatggattgatgctcaattaacggaaaaagggaagtctcaggcc

SEQ ID NO: 13949 - DNA, 469 bp, Saccharomyces cerevisiae
ttttaattatagaacatggtacttgtacacatacatagataaaaatctttgctttaaacttcttttaatttcatttcttcttgtatcagtagtttatactttttgctactcttctttttctttaaccaaccttttatcgatggcggtatatacagttgagcatagtaatttaatatcacccatacaatgataaacattgtaaaactgtttgatataggggtcagctgtaacatcttaccaaggtatgattctgtatccaaagtcattagcagtagacttgcaccgatagagacagtgatatcaacgataaattcaaagttttttgacatcggctctctatatggtggacccacagacaaaactatagcagtcaaaatatattgaaaatttgagacgaagaacaatacggtattatctgaagattgcacggcgtcgtcgcccccaacgattggcttgatgtaccagctca

SEQ ID NO: 13950 - DNA, 413 bp, Saccharomyces cerevisiae
tagattcacatacccaccgctatgtatatattttcctatatgtatattaagaaagacaggggcaatctacctgttgaataattctataaatgcctcaaaggaggcaaaatcaaggggaaatactaacctataaccttattcaagttagtagaaatgtatcaaagaaaatgttcctgttttttccggttatcttattatctgcttcttttaagttatgcccagttagtaggcaactattgcggagaaaagaataagggaatcaaggtcttggaattcattctaaaaaataaatctgaaaagaaaaaaattcggatatataagaagtctttacacgttggccaccgacactgtactgaggtaaaaatcttctgtgatggtaaatcaatgtgttattttccgattgtttgaagaca

SEQ ID NO: 13951 - DNA, 476 bp, Saccharomyces cerevisiae
accgagtaagctgctacataatgtctatatatctacacataaaattccgattattcctttgcatacctgatttgcccctcagaatccacaaccagacttttcaagaaggtcttttttgcccctttatccttcatggttttcaaaattttgtacaacgacttgcccttgtgaagctcgataccgttcgaggtcttttccactttctctgccttcttgatcacaggcttctccactttctttgcaggagttgccactggctggtgctggtgctgcttctgctgctgcttctgctgctgcttctgcttctgcttcttgttgcccttgtacaacgctttctggtacttctcgtcctcgctgatgcaagacgtgtgattcttgtaactcacgccatcttcaaacgtcttggagcaatctatgcatgtatagtacgcgttaggacatctataataatgcttttcggtattcttcttgggcac

SEQ ID NO: 13952 - DNA, 415 bp, Saccharomyces cerevisiae
tcatatcagcttgttcattgctcttatttttctgcaaaaatatacatatatatatataagtaagtgttatatactacttgagattaggcgttgtaacaagattcaaaaaattcgaactcgaactgtgaaaccttcacaaatatgctttccacttcttcgacgggaaacttgtcaacttcagcctttagaaattcacaccaagtttgaaaatgctcaccatcatgtaaatcaatccatttttgatatttccaatgcaaccctggggctctaggagtatcacgagcccatctccaatagagttcctcagcaacccataagctggttactaaggatggccatgtaattgaggcgtcctttctcagctcatctaagaaattaatatacgcatcaacgccggggatcgctttattgtcaa

SEQ ID NO: 13953 - DNA, 400 bp, Saccharomyces cerevisiae
gttgactatttacagctcatctcatagagacattcataaaacattttcatatttacatactatgtatatataaaattggtaatataacagattaatgttcgtagaagatgatgtgttttacggtggcaaaaggcgagcacgaaatttggcaaagggtataagtaattaagcaaatttggtcaaatctataattcttcactaacaaacttgcccattggtctacataaggtgcgattcgtataaatttggaagacaattgcaagaaaatggtagacgaaagtgataagaaacaacagactattgatgaacaatcgcagataagtcctgaaaagcagacaccaaataagaaggataaaaaaaaggaggaagaggagcagctatccgaagaagatgcaaagct

SEQ ID NO: 13954 - DNA, 414 bp, Saccharomyces cerevisiae
agtaaacggcaacagtgtggtgcgtttaatggtgctaattatatatacacttttcattatattattatagatactcagaacgtaggcactatgtagaaaagcacccaaagttcgaaatatcatatgatatacttctatgcatgtcgtagaaaaagacaacaatctgaattgcaacctcaaaaaaaaaaatcttagtactacatcatatttgtgccgtggcctagctgtatcgtgagagaagggagaataatatcagagaagtggggtgagcaaagtataacaaccacgattatgagttcaagttcttatagggattcatattttcaataccgccatttaccagcaccacatcacatattatatgcggaatggaatcaagatatactggcgcttccggacgaagtggcaaatatt

SEQ ID NO: 13955 - DNA, 458 bp, Saccharomyces cerevisiae
aaaaacatgctaacaggtcatgcatttttagttcatcattacgtttccagctatgttatgtatgtatgaccacatatgctgtacataaattgtatactaaaatcaataaaaaaagtataactctttttatatataatctttttccttcctaaagtgtccatacattgatgtctccatcgttgtgcccattgatcagaaatccgtctttatacttgacaatagcaattcttctgctcagctcatccccatctagtgaatgcggtggttcaggagtcatccaatgctcatcgcgctccatgttaaagacattaacccctccctcgtttgcgccaacagtgattaatttaccatcgaaatctaaggacgatactggtaaatcgtaagcaatcacgtcaagaattgagcttgtcctcaaatcccaaatccttacgctattgtccatcgagcctgttaccaat

SEQ ID NO: 13956 - DNA, 486 bp, Saccharomyces cerevisiae
tcaatatgcgcgcttgataaacatgctaagagataaattcttgaaaaaaaatagggcctactgtaaaacgaagtgacacgtaatttcaaatttaatcaacaaaaaactacgagtttctttgcaaactccctttttcggactactagtactatataaaataacgagttatttagtgaaagaaagcgtttggttaaggcaacattgtacgaagttctgtttctttaaggcaaagcagagtataaaaagtaggatgcttatggagtgaaaacggagtggtgatgaagatggggaagtcaacataggtccacttgagtgcttatggaagatccttaaaaatgcatttccaggaacgtaacactgtaccattcctctaaataaagtgtatacaataatatagaaatatagattcttcccaaatattcagttgttactataaagggaatatttgagctcgttattagcgtggccgcacaaacaaccatcata

SEQ ID NO: 13957 - DNA, 433 bp, Saccharomyces cerevisiae
acagaattgattatagttgcaaaaagacgttctataaatgtttactagtagtatttattttctttttttatttccatcttttagtggccaaccgttttgtatatattgatttttcttcgtagtggcctcaaaccgtttgagccacttaatggcaaatgatagcgaactttctcctgcttttaggaatactcttatagacataatgcattgatttccacgaacgttcatggttggtaaacgtaagggaattgtgctatatatatatatatatatatatgataatattgtataaatttcttaaggttgaaacctacctagaacagtttaatagaaataaatattgtccaaatttctttttggttgtagaatgttaattgtgatatttcataaagctatattttcaaattcttctctcgcttcttccactttagca

SEQ ID NO: 13958 - DNA, 482 bp, Saccharomyces cerevisiae
ttttcttcaaaagcgggactaggcattataatttttatcaaaattttcttctcagaagttttattttctttctctccatttcttccatctttttaatctttgtttcctttttttacatcatattacttctacctactctactctattctaatttcaattgattttttttattttatttttttttttgttaataaaagaagaaaaaacttaaaaacgaataagaggctgtctttgttccgtagtatatgcctatttccttctagaagtttgaagtgtcgtaaattttacctacggataatgttcgttacattgttgaatggcaactgtagtgaggtaatgttcaaaaagtgagaaagcgggagagaagggctacatacaaaaaccaattctagataacatctatatcttcgtttttagaatatattgtaataaaacacaattgataatacagttctctcttcgtcctctgatggtgggagatc

SEQ ID NO: 13959 - DNA, 452 bp, Saccharomyces cerevisiae
ccttgaaaatacattgctaagagatcactaaaacaaacaggactgcattggtgctgtgtattttttcaagggcaaaacaatcaatatatatatgaaaagcttacgactaaataacagttatactagtaacgggtaaaaaatattctatggtgttcaagcctctattttacttctacctacattctcaatccaaattcaaatcttcttctagactttcattagcaaatgcaattaaagagctgactgccattaaatggtcttcttcctgcttcaatccacttatagttaagcaggcataggggtagtcacttctctccgattgtattaggacagcacctccatggaaagcgtattcttttgagtccacaaaaaacttttcctccggtgttttgtcacttttcttgcagcccatatagaaacttgaatgaccaaatcgaagcgctgtcttcttc

SEQ ID NO: 13960 - DNA, 436 bp, Saccharomyces cerevisiae
taatattgacgaacatatgtaaataagatatatgttatattcttctttctatcaataaccatgagattgtgcctcagtaatatttgagacgatttagagtaaggtcaaatattattattaatcaagttgtgtaaaggctcatttgtgaaggttagaatagtaatcgatgattttcaagtaaaagtgtttgaagggcatttcagtaacatcttcaaactaggagtttgttgagacaaaaaagtctgattttcataagatcataacttacgctttgaagatcgttatgagtaccttgtagcttgccagatcttcttgcttattcttaagctcttgggtagtactgtataagactgcttgacatcgggaacactatcattaccgtgtgatagaattctcgtaccaagccggttcacctttgcgtggtctagtgcatagg

SEQ ID NO: 13961 - DNA, 489 bp, Saccharomyces cerevisiae
ttttatcaatatttcgatacagttttgggtgaatcttttatcatgcttaagtcaatagaagatgcctacatacctcacgatatgatgaataaacagtaaaaatgttcgacactgacgacaaaaaattgacactattcgggactgatgtcatatagaaacataaggtcttactatttcgttaatttattattgtgatatgtatttacagtgtaatatgaagttgtgtttaaactatattttaattccagggtttatttgtttggctctatgagtaacattttctcaactcaagacagaggatgcttttctatgatggctaaattgcctgaaaccagacaactaggcatgccaccagattttggtgatgaaaaattgtgaatcaaccttaaatccagaacataatagtataccttaccaaagatggtggcggaacgtttacataaatgcttggtaatgcagttcattctgggttagcgggctcatttttca

SEQ ID NO: 13962 - DNA, 453 bp, Saccharomyces cerevisiae
tatattacgtcatctgacatacgacactgataacaaataaatatataataattataaagatgcgttgtagaaaatcttatgttcaacaaacaacccacatatgattaacagaccattttaaatgtctagttagaaacaattatttggtactgtctttgaattagattgtttaataaagcatttctaatataggatacaaagggtcaaatagtaccgtgagtagaatcatttattccacactttatccgcaaaccttttaatttttctacaatttcatggataaaaacagattcatggccagaatgcgtaaagcaactctattgtacaattttccactctgagatattcacacagcggagagcccttctactcaatgcgtcaagaacaatgttccaaacctagtgtattttaggtatattattacgagagtatccgcaatgttaatgacgcaaa

SEQ ID NO: 13963 - DNA, 460 bp, Saccharomyces cerevisiae
taaactttaatttgtgaattttccttgtcttacacctataatcgttaaaaacagtccctttatgtctactattgtaagtttctatttttaaaaaaatacccttttcaactatgtacctttatgacaatattatatttactaattgaacactttagcgaggattgaataatgtgcgctactatataaaaagactgccttcatcatatattactgcaaagctcttagtttctttcgaatacggaacttcaatcaggctgtttctattcctcgcttagtaatttgatatgcaatttgaccaggcttagcgaatgtggaatataccactttcattgtcctcttaacttgccagaagcttgccgaatcacctcccttataaagatgagcttcacctctttgaattattgttgaagccttgaaagatttttgaagtaatattcgtgttgaaacgtgattggaccaa

SEQ ID NO: 13964 - DNA, 402 bp, Saccharomyces cerevisiae
agtctgcgccaaataacataaacaaacaactccgaacaataactaagtacttacataataggtagaggcctatccttaaagataaccttatatttcattacatcaactaattcgaccttattatctttcgaattgaaatgcattatacccatcggtacgtctagctttgtcaccttccccagtaaacgctgtttcttgccgacaaacaatgtggccctctctccgtcaatctgtaacgacccaaatcgtattaaagtttcgccgtcctgttcactgaaccttccctcatttggagaatctctcctcgccagcgacgcaaagtccttaggcaactctagttcaccttgaatctccagcatcatcatcccaagcggtgttatcaccgtggtctgcttttctctt

SEQ ID NO: 13965 - DNA, 495 bp, Saccharomyces cerevisiae
atagaaatgcatatcattcttcaattacagtttctttttcttttgttacactattctttcaagtcaatttcataataatacaaaaccatctttcttatcatatatagggtgatgtatttttaattatttaatagggcctagcgttatcgtgcgaagattaattattggcatttttgaaatactccttggaatctttaacgtcaggtttgatggtggcggctcctggggtccagttgcatggcaaaactgtaccatttttgtcagtccactggaaaccttcgactaatctcaaagcttcattgacgtttctgccaacagataaatcattgatagtgatatgtctaatgattcccttcgggtcgattatgaacaaacctcttaaagctataccttctttttcaatcaaaacgccatagtctctggataaggaatgattcttatcagcaagcaaaggaactttaactggacctaatccaccgtcttttctgggaaggt

SEQ ID NO: 13966 - DNA, 431 bp, Saccharomyces cerevisiae
tatcctgagtcactccttaaacctacatacattgccatagaatgccatttattactatataaagtcgcatacgtacaaaaggacaagatcttatcttcgaaaacaagaatatgaaggatttaataacattgccaggttaagaacggtgtaacaacaatagaagtaacacaacaccaatagcaaacaaaccaactacagatatgacttacacattggcaattttaggctgcggtgttatgggccaagcacttctttccgccatttataatgctccaaaggcggctgatgaaactgctgctgcattttacccttccaaaattatcacatgtaaccatgatgaacctagtgcacaacaagttaccgatctagttgagacattcgacgaatctcctaacggtattaaagtcgaaagcacttacggtcacaacgtg

SEQ ID NO: 13967 - DNA, 455 bp, Saccharomyces cerevisiae
ttataataattccttattttcccttacttttttttatcccatatcttccccacatactactactgttttaattgaaatttaaattgaacttgaattcaaattttttagatttagatttgcccctcattgaaaatctttctatctttatttttttattttatcttctctacttatatttttattctacttcaagcgtgttttattatcattattctgagacttataccattttctttcgttttttttctgattagctatcttataaacactgtatcaattattaatccgacatccctttatcaggacttctttcatcacttcaccaaaacgcgtggaacataaaaataaaacgtcttaaattcttcttcataggtgcatgtttatgtttttaaatgcttatacatttgcaatataattatatatatatagatgtttaagaacggaatgatgcttcg

SEQ ID NO: 13968 - DNA, 460 bp, Saccharomyces cerevisiae
ataacgcttggataaaacgaagtaaatattagaaacagttatatagaaattaaatacggtgacctggaaaattaacaaagacagaacaaatgtgaatgaataataatagcaacttccaaaaaaaaaaaaggggttacagggatcaacaaaaaaaagcaagaaaaaaaatgaataaagggaataccataaaaacaaataacattaaacggatgagggggtcataacggaagtgtgaatataactacaacttgctttggcaagtaatattttcgggaaaacagatgatcatcaagagaaggtctatcaattgtgggcttaaaacagatgtgtagtacacttttgtgccaaaaaggagggggttagttagttaaagaagaggaactcatgcgaagttcgttgaattttttttcgaacaaggaaaatttgttggaaatcttagaacattcgttatcggactcgc

SEQ ID NO: 13969 - DNA, 436 bp, Saccharomyces cerevisiae
tttaggtttgagagctggtagtatcgacgtccagaacagtcaattcatcggaacgctttcgactcggtccacggaaaagccattcaacgatttatacggacggtgattttgattagtctaattgcctatatattataaatatattcttcctttacctatttcttctcacacattatcctctaagtaacatgagaattcagatgccggttaatcttcggctttttcgcgttgaattcaaaaaatgaaaatgatgaacaaccactgggaattcaccatttttcaaagtgtgtaaattcatgcctagggccttatcaataaaatttgacaatacgtatatggacctttacgatgaattaccggaaagtaaactcctttatgatgaagaattttcatatcttttggatgcagtaaggcaaaatggtgtctgcgtcgtaga

SEQ ID NO: 13970 - DNA, 440 bp, Saccharomyces cerevisiae
aacatgacacctccataacgtttacctatactaaatatatcttattttttggattcttggtacataaatatgcactgtttgttatcacgcgaaacgaactgattttttaacaagctttattttatacatgaaaaatttcccatcgatgagctgtgatcggcaagtgagagtactctgtttcacaactactaccggtcccaggaatatatactactgaccacaaagctgtgtatcacttagtttgatgagcagcacgaggaagttcaaaaaggttgagaaacctctatcacaaaccagacattattcactctgtatccccacgacattggtatcggactgtcgcaacctctctcaaatcacgcataaggtgtaccaagtggccaagtttgcatcgctgtttaatgtttctgaggttgtcattcttgaggacaattcccagg

SEQ ID NO: 13971 - DNA, 404 bp, Saccharomyces cerevisiae
tcagtgaatagcgttccgttagaaaacattcaaaattacctaatactattcaacagttcttgttcctcatccggctgccttctgctttaaactaattgttaatttattcccaaatcatattctaaattaatctataatcatttttcggattatatatgctccatacttaataaatattaatactctcatttccttttcacttttttttttctcaattagcattccaggttcgagaaatatcattgatatatcgtaattccttttcagtaaacgtgattagacgaccttcgtcaagttcagagtttgtgtgtccgtcacccgtagcatatgcacaatacatataattagaacattccttgatttgcatccatggatgaacagaaacgtcaggaacgattagtccc

SEQ ID NO: 13972 - DNA, 408 bp, Saccharomyces cerevisiae
aaaagttaccttgttcgtagaatcactcaacattcttaaccaatggatgatcttgtagcatcatagtgagtaagtagattatttgtgtatgcatacttaatttaaaatattctaaaaccattatactccatcttaaagcataatatatatctcttgttcagcatgtacttgtaacaggaaaaggatattatgttcagaaataatcaaacagcctcaatactgacatcaggcagtcgacaggaataacttcaaaataagttccgatcacaacgttattgtaatggaaccaatgatcgctcattgattagtattcatattaacactatattaaaattgagtgtgagtagatggcacaaagactgagaaataatcatcaaatttaatggaagccgaaatgcaagacttgat

SEQ ID NO: 13973 - DNA, 480 bp, Saccharomyces cerevisiae
tcatccaaataatatccttgattagataacaattgcttatctacgtatatatatacatagcacaatctcgaaaatataatactaataacaaaataagtatttaaagaagggttgatgaagtcctagaagtaccagacctgatgaaattcttgcgcataacgtcgccatctgctaatttaattgggatttcaaattatccaattgcttcaatacagcagatttagcggttccaccagtagcatctcgtctttcaacgctttgttcaaagttaaaagtttcaaaaagatcttgtccgaatctcgaatcgatcttttgatactgctccaaggttaatttatcaataccgcttagaccaagtctttcagcagtagcgacacactcaccagatatgtgatgagtctctctgaatggaacaccctttctgaccaagtaatctgccaagtcggtagctagcatatccatcgtgagagcagcttccat

SEQ ID NO: 13974 - DNA, 464 bp, Saccharomyces cerevisiae
gacgtgttgtaacagagtaatcatgtaatattgtatgtaaggttatgtatgttcgtatggtatggaaaaaaaaaaaaaaaaaggatgctatgtggagaatgtaaggcgtggtagctccggataattcagtctgtaggcttcatcacgggcagtggcctgactctgagagcttgctccggtattaagttgtgcgtttgaaattttctggaaaaaagaaattgattggttgaagctatactcgtcgaaagatttcttcggcagtggttgttgctccacctgcacgggagttgtgtttgcgtttatgttcggcttggctatattattagcgagtgatgtttgcaatttgctgtattgagaatcaatttgggtgcgtaagctttcaataattttgcagaccgcaggcacttccaactttatgagttgcaggtattctcttttatgaatatacgatgacgacgatgacg

SEQ ID NO: 13975 - DNA, 434 bp, Saccharomyces cerevisiae
aagaaactgctacatttattttttttaaaattcatagcttatataaatgacaccaataaattgcacttatttcttttatgctatgctattgtttttgatacccttttaaaggtaccggttaaaaattgagagaaaaaaagaaagaactcctcatagggggctcgaacccctgacatttcggtatccttgcttaagcaaatgcgcttaaaagccgaacgctctaccaactgagctaacaaggatgagttcttcggagaatcctggacataaatttgtccatgttattttaaagttttatcagatttgcactggtctttaccgttccaacactttgtacatgttgataataagaataaaatatcatccatcgactgctattcttcatatcaattgtacattatcatatatgatgtaaggtgattgggaaacagtca

SEQ ID NO: 13976 - DNA, 455 bp, Saccharomyces cerevisiae
ctcacgattgccagttgtttaccgagatctctcattttgaaggctcttaaaatgtgctcggtcggccgggaattcgcgaaaacccacattcactaataaataccattacaataaccatcattatatagatacacatgtgtagaaaaggataatatacgtatatatatttgtttgtaaatctttaaattttcaggaacagggttagcaagcatcaatgaaagcagacgcgaaacaaataacacatctactcaaacctcttcgacttttattattgggggctccagggtcaggtaaagggacacagacttcgagattactaaagcaaattccacaattatcttcaatttcgtcaggcgacattttacgtcaggaaataaaatctgaatctaccctaggccgagaggctactacctacattgctcaaggcaagttattaccggatgatctcataacgc

SEQ ID NO: 13977 - DNA, 483 bp, Saccharomyces cerevisiae
tggtttggtgcaagaaattgattctgatgctttattttttacggtacactacattgtgctgtgagttgtaataatatagtctgtatatgccaagtgaagaaaaaaacaatacaaactcaaggtgtattatgaggtagggaatacacataacaatatatatatatacgtatgtatatttaaattgtataaatgacgatcttaccgtctaacccacaggaagagacttgtgtgatttggccgttggattccgcaaaaggtcttaattccacaatggcgttttcatgtgcactttcttggacatctgtgctaactttacctttcaagtctaattctttaaactttctcaatgcggaaataccgaaagttgaactttcatcattattaccactcagctcgtctgtattaccagatgcagttaaggcagaagacttgttattgtctgatttgtctagattcttcgcaaatttccagccttcagaggct

SEQ ID NO: 13978 - DNA, 418 bp, Saccharomyces cerevisiae
atttttgtataatttcatcatggaggtgcatgggtttccttctggtatgataaatgtgagccaaatgaattgaaaaatacaaataaagattatgtacgtagatacgcgttataaagaggactatctgatcattggggtctttttcgttgtgaaattgtaacgggtgaactcagtgattaaaaaattgcgtgatgttgagatactatggggcgacaagaaacttacccttagtattcagcattaacaaattaatgttgagggcgtcatctttcaccaggccatttcattatagttcatattctctacagaacggtgatactcctgataaaggcagcactaataaaaatgaaatacggacacctaataacgctgtttggaaagaaaatatagaacttcaatggcagcacttgaaaaagaa

SEQ ID NO: 13979 - DNA, 468 bp, Saccharomyces cerevisiae
tgcctcctatatttagccttttttgatataactgtcggagagttaacaagcggctggactactttctggaatagcgttcggaatgtgttttacttaaggattcgaacgtgatcctaacgagtggatgcacagttcagagttatctaacaatattcgtgaaggatatgtcaaaattggatacgcttatgtttatgatatatcatttatattaatatatagtatgctcacattttcttattgctgaatagttcttttttacgtttagctgagtttaacggtgattattaggtggattttatattagtctacataaaaataagtggtggatatctacataaaattgtcataacgcgtaaactaaaaattatttttatgatcattgaggatctataatcaactatagacattaatgtatggataatcatgaggattataggtaaatggcaagggtaaaaaccagtgaggcca

SEQ ID NO: 13980 - DNA, 486 bp, Saccharomyces cerevisiae
caacgcgtcaataatataggctacataaaaatcataataactttgttatcatagcaaaatgtgatataaaacgtttcatttcacctgaaaaatagtaaaaataggcgacaaaaatccttagtaatatgtaaactttattttctttatttatttacagaactctgaatatacattgattgttcacattttttttttctcttctcaatttcccttgattatattcaaaaggttattggcctcttgaatgtttcccactgatggtcgacgtgcccttctagaggtcaatggtttataaattggtctcttattgaaaaattctctggtcttgtcattttgtggttcgagtaatctagcgtgcatcgaaacagaaccatttttctccatagatgcctccaagatctcgaacaagaacgttttcattctgatgaaatctcccatggagttaaaggaactaggtggtgattggaaaaataccacatcggccac

SEQ ID NO: 13981 - DNA, 454 bp, Saccharomyces cerevisiae
gtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggataacgattctgaagttactcttagcgttcctatcggtacagccatcaaatcatgcctataaatcatgcctatatttgcgtgcagtcagtatcatctacatgaaaaaaactcccgcaatttcttatagaatacgttgaaaattaaatgtacgcgcc

SEQ ID NO: 13982 - DNA, 402 bp, Saccharomyces cerevisiae
ttatgagaaccagccgttacaaagaatattttctgtcattaatatatttgtataaataaaacaacaagtctaaagatcaagtagaaaaatggaaacaagaacgagcacatatatggtatatagtgaacatatatatattagatatatacgttcaagcgtcgaaggacaaagaccaacctagcttgtgaacaggttcagacaacttcaaagcatcgaaagaggaaccgacacccagagtgacgccaggtcttaacaattgcttgtaagccaaagtgacaataccggaatcggacaccttagccttaacttgggaagatgcatcaggcaaatatctagtggcgaattcgatgttgacattggagttaggtagtttgcagttcattgtagccttagcaccgacct

SEQ ID NO: 13983 - DNA, 402 bp, Saccharomyces cerevisiae
cgggccttgaaatttctttaatttaaaccatgaatttcagatatataacactttttaaccactttcaagagaaaacagtattaaattacatactgcgttcacagctatacgtaaaaagagtgacaagtgaagaataaacgtcattttgaaaaaggaattagaagtctgtcatttcaactgagtttttgacggaggaattatcattatcgggttctccaataaaacttagcttgttactacttcttttactttttttttctcgtgttcgatgtccactttcatctgtgagactattattcccagcattgtctttctggaacttagttgtcgttttaaatttcctcatgtttaaactagaatcgtcgccactatcttctgcttgcccccggttcgtaattttat

SEQ ID NO: 13984 - DNA, 449 bp, Saccharomyces cerevisiae
ataaataaaaatatagtaaaaaagtaaatagataagcagaaaataaaccaaaaaaataacatatttattttcttctgcgtgaacgcaccatgtggaaaaagagagttgatagaacaaaggacaaagaaatttagaacggtaaaaatattttctagagtataatatacatatatgtgtatatatacataggttagtatgtatagctaggtaattttaatctggggagagaaatggtgaacttttttcaatttattgattcggttgttgattgatatcttgtggtgctgcttcaatttcagcttgagtttctactaaattttcagggaccattggatgatcaaggttaaataaaacgctaccaatagtatttgtagaaatggcaaagcccgctaaaatgggcacggactcaatcaaaccggccaagaaaccaaatgaggcatattggccag

SEQ ID NO: 13985 - DNA, 484 bp, Saccharomyces cerevisiae
gctttgtaagcatggtttaccttttaacgcccaaaagttcaatttaacttagaaatatttatctatatgttcatatatacatctatcaatatcacataaaattgcctatcatttcttattcgtttcctatttgtttctcgagccattcataactcattccgcgtaatgggagcggtaaaagatgtgcaaaataagtaactatttacgaagtattcatattttagctctttttcttcgtcgaatgtgatggtgaaattttttccaagagatgatgaggtcggataatatatgaagtacatggtagtcagctcgcctatacaagaggttttaagattacataaatatattgagatctctactaccacaatcacagttaaaattacaaataagatgtcctctccagtgattggtatcacctttggtaacacctcttcttctattgcctacatcaacccaaagaacgatgttgatgtcattgccaacc

SEQ ID NO: 13986 - DNA, 464 bp, Saccharomyces cerevisiae
taaaatacttccccgctatttgtatatatgcatatctttatattatgaaagatatttttttatttacttttagtccgtatacttttattttgttttgttagacaatctcgaagaacaaaaaaaaaagataaaacagaaagataaatgtgcactcttttgtacctcgttctgctatagtacttccaaccagatcgactgaaagattactagtatatacgtcatgtttttaaatagtagttcccattctgcttcagtgaattagatatttttttccaatcattctctttaaaccctctgcgatagtgatccaacattttcttagcaacgctaatccttctgccaatagcttctcaaaatatacaccattaactttacaacattacataatatgacattccacagaactctctattccattttaccccatttcaaattactttttagtctttgaattgggtcgcttc

SEQ ID NO: 13987 - DNA, 422 bp, Saccharomyces cerevisiae
atttgccgtcagaaactgttcaatgtatgtaagtaactgcatctgtaattttatctttagatagtagaaaattcatgtttaaccgctttttcacttcatgaacttttttttctccggtgtggaaacacaaagattcaaagcaaaactataaaaaatcacgtcaattacttctgaaatagatagaagaaatgcataaaattattgctgtttacttaaaatataaacttattctgcaatacattaattgatcagttcgaaagggttgctgtgcgagcaacgagatccagatactcttttaactttccactagattggaataataaataaatcttgtcgttctcattagcgaccaatgaggtaaatgccagggcttccgaaataaattttgggatctttaacaactttgcggcttccactaactt

SEQ ID NO: 13988 - DNA, 406 bp, Saccharomyces cerevisiae
acggagccaaaattagaagaaaaaaaaagatagggtgagagaggatatgaaaaagcatgtatattttttttttttttggattctattactatcattacataagcgtacaacaaacactatttgagtttgacatttggctatttttttgagcatttttcaaaccctctataaaatgatttgatcctgctacggggtagccccatagttctggtaatgtataatcttttgtattcgaggtatagtttattattgtaagacatgcatttgaagcagtaattctttcacggctgagttctttcctcagtttattgttaagttcgttgattctttttaacttcaattgttttatctttaaggaaagctgttgctgttgctgttgctgttcctgaggttgttgtaagcgtgg

SEQ ID NO: 13989 - DNA, 457 bp, Saccharomyces cerevisiae
tgcgtttaattaacttactgtcttttttttttttttttttttaaccatattacgttgacgggagttttctgtgctgctgttatttgtttcacagaactctctcctcttccattgctatcgaacagataaaatggaatttctttatgtataattactattgtataatattcagtaaatctaaattttaagctcatatatctaaacactacaacatggaagcagcttgtcctcttcaggctcactgtatccgtttactcttatttcgcgtatttgcataccattatctcaaatgacttgttattatatcttgatatatattgtattatagaacaatttgtgaagagaggtccatattaagatttcctcccatttacaaatagaatagaaaaggaaatatatatgtagtaaaaaaatcgtgatgtatacaaactttggatttgtggagatcgtaataaat

SEQ ID NO: 13990 - DNA, 437 bp, Saccharomyces cerevisiae
accaccctgagctgatgcaatgtaagttataatgtcaaaggagataagaataaaacttaaaaaattcgaaaagaaataaaaaaataaggaaaatctttaaatagattttaattgcgtaggaatctttgttctcatttttaaacaagtattcacttttatgtacattttctttcctaaaaatctttatacagagttgagttgtgagttgtgtaagagacgtccaattttataacaatttgtagacatctcagtgccccaaagagaactatatgattgaaaaatggagagagatagtatcttgtacagtttatatatttacatgacgaatgggaaattatatatgccctttgcctttctgccatagagcatggctaactggccaggaccatgagattgtattcttatttctcctctccgaaaaatgggaactggaaccc

SEQ ID NO: 13991 - DNA, 474 bp, Saccharomyces cerevisiae
tttttccctccttttctttatttctcgctcactagcacttaatgttataatactcggcaaaaactagtaagattaattgtttttaatttttttttttctatacatccatactactgaggtaattagtgtttttaatatcccttcctcttgtataatatttttggggctttatagccgaccttgacgtatagcagctgagctctatggtttgactcatccgtacaccaatacacgcttggtgtgcccagtttatcagcttcgtcgtagacaaattggattagtttgccgcccgcgcctttgaccctagaattctcatcaacatagagatcgttgatgtatatcttgtccttgaaatcccaagtagtcatatggttgaaaaagtttatcattccaataattttttcgctcgaactttccacagctacggctgcccacattttaatgttaggatctaggaatctgccgaaattgaaa

SEQ ID NO: 13992 - DNA, 406 bp, Saccharomyces cerevisiae
attttttcgttttttatttttttttgaattattctacgataattatatatatagagccactgcatgttttactccctttttgttgactacatgctatttaattaggttaggttataaatctctttattattgtttcttataacataaacattatttttcttcttcaactaatcaattcaatatgcactatgaatgataattcagatgcgcagaacacctcttgccgaattgacaccagcagagcttaacatcctcaaacctgttgcaccgaatgggaaatatgaaatagcataataaatgacggcaactaattcaagaagagcacatgtaatagtcagcaccgtgttcttggaaaaggctgcgaaataaatcgtcatgaagcatgtggcgaaaaagaacatcgaaa

SEQ ID NO: 13993 - DNA, 402 bp, Saccharomyces cerevisiae
cccatatggagacagaaagtaaatcagaatctatattaacatatacgtatatatttgttttgtgtacaataactactacaaaattggggacagacgatataaaactagaggaactgctgagcttattcgtacaagtcttcgtccaatctagcagcaggattggtttcgataaagtccaaagagactttatgacctaacagttctctgatgttttgaaccttatatttgatcatggtaggtctttccaaggataacccccaaccaaggactcttagatcctttggtagacccatggactcgagcatttctggtctgaacataccagagttaccgatttcgacccatttttgcaaaccttcgtgccaagaaaagatttccattgatggctcggtgtaaggattg

SEQ ID NO: 13994 - DNA, 496 bp, Saccharomyces cerevisiae
aataatatgaaaaaaaaaaaaaaaaaaaaaaatcagaaatattttatgaattattcaaatagactaatgaagtgataaaaccaacctttttttttcttctttaaggtatattgttcgacgcaatcatgaagtgttgcggttttttgtttatatttttctataactgttttcctttttcccaaagaattatgcaaatgaagaatatctacgtatatatggaaaataatttaatagatatattttgatatgactaagttatgaaatagaaaaaaataagaaaaaaaaaaccttgactaattactataaagctccgtaaataattccgaaggcgtcgacccattgaccgactctgccagtcacacctaggatatattggccattaggtggctgcaattcagcgaacccacctccgtctttgttaccaaacatgtcggtcattctcccatgactcgttataatttggatagcatcaacccaagctccgcacctcagatta

SEQ ID NO: 13995 - DNA, 419 bp, Saccharomyces cerevisiae
ttttccctacggagtactaccatttatatttaaacaatgcactctgctcttgggatagtccttgcgagacccttttttcccaataggaatactacgttcgtactctgtgtaaaagtacccaactatagttagcgccagttttacgtaaaaccgtctatgtcttgtttgcattcgcaacagctacaaacacatatagtttgtcacactaatattaataatgaaagttattatgtattcactgtgaacgcttcagtatacagtacggcagtaagtgtttcattctgttctggattaataatctttcactttgcctagccatttgggggcgggttttggctgggttagcttctccttagtcatggagaaaaaaaatcgcccgcaagtatctcgaaaaaggaaaaaatgcccacgcgtataag

SEQ ID NO: 13996 - DNA, 400 bp, Saccharomyces cerevisiae
ggcagcttctgaatcactaaagcaggaatagagtatacaaaagaatctttttgtgagaaactatgaaaactatcaaaatttttcatcttagagattgtttatagcccctattcttacttcatatccaaactacctcatttcaagcttcctttttattagtaccattattattgtttaaaagagtattacacgctaaatatgtatatcttaatttttaatgtgtataaaatagaaaatttgaatatcaaggagcaacaaagagcattatgcgttttaagctacacaatgggtacgatgagatcactatacctgtactcttaaaagaggcccaaccttatcaacttctattgttaaagtagacaattgtatcgtttctttttcttatcggttttatccgggt

SEQ ID NO: 13997 - DNA, 444 bp, Saccharomyces cerevisiae
gaaggttggtaaaaatttgtgttttttcactattagctgcaagccaggtggtcaaaaaacaggataaacaagaagataggaattaactataaatatgcaggaacaagtttcttccttaaaaccactttcttaaaatggtccttcctttgtctatattgatacttttttttttgacggtttcaatgttaatactgacataaattatgaatattcaccttaaaaactagtttaatgacagaaatatgtataagttgcgtaacaagcaattatatatatatgtatgtatatatttataagcgctaggtttctttttacaaatacatagaaaaggctacaatattaaagctctattagcagttcctcttgaggactaggcggcctttcctctttgatcggaatttcagaggaacttgcaggaagtggtacagttgactccggttggac

SEQ ID NO: 13998 - DNA, 497 bp, Saccharomyces cerevisiae
aaaagaaagcaaatatagaaagcaacaaaaagaacatcattccagtatattattttatataaagaaaatgaccttcaaataaaaatagaaagtacgtattcttatcttttttttttcttttgtatatgtaaaacaatactattagtttttgtttttttctttaatggaatgggtttctgaaaagactatgtttcatctcgtagttatcattgacgtctgttgtgggccctgtcctcgtttcattcgttaccacgtcaattttatagtttgccgaatcattattgtcccaatattccttcctagaacgatcaacgccccaagttaagtattgaatacaaaactccaattgtgatatattgctatctttatcatttggattgtgtatatcatcaatggagaacttaaaaatatccatattgcttcctggtaagatgccattggcattagaaaaatacacgcattctgattcatgaaaagttctccatgcatcccatgta

SEQ ID NO: 13999 - DNA, 409 bp, Saccharomyces cerevisiae
tattttggtaaagtccctagaagttagtatgacttagatattgaaggaatatgagtatacataacaaatatataaaactttgcatgatttttgtgtatcctctatctttcactattaaaaaatgtacgattaccttttctttctatcttttcatgaattggccacgtctcatgacgttcttacgaactttccacacatgttccaattttttccttctttcaaaagttgcgaacggtatttgtatattatcatcccatgtaattgtgcggggggatggaagaaagtcacaaaaaggagtttccgtcttatttcttactattatccattgagcatcctcaggttgtttatctaaaatctgggtatggcaaggtggcacgtaaatgttcattatttgctgggaggtgtcaat

SEQ ID NO: 14000 - DNA, 475 bp, Saccharomyces cerevisiae
cccttcaacttatatagcacctttacatatctttaatttttacgaagagcattttattcaacttttgtacctttaaagacggttttcagcccacacattttttgttattttacaccacacagtaaaactttcttgcttttttttcttgagactccccgaccattgttcgatattccaattttcgcaatcttcagaaaagggtatcctaacattctaaattaataataaagaagagaggctacaagcatttattagtgtgaagcatttaaagtaacttcaggaaataaacgcgcaaataaaccaaaaatgtccactgattctattgttaaagcctccaactggagattagtcgaagtcggccgtgtcgttttgatcaaaaagggtcaatccgcaggtaaattggctgctatcgttgaaattatcgaccaaaagaaggtatgttgaacctaaaacccaccgtggacaaactgaggag

SEQ ID NO: 14001 - DNA, 427 bp, Saccharomyces cerevisiae
ttcagttaatatcagaacaatttaattcatttatataaacatatacaatcaatcgaataaaaatacaacaatgtaatgaaaacgctctctattgatatgtatttgctgacgcttataaatttattaaagttttattttaaaccgttctagtgacttcacgcggggagatacatccaatagtaaattacaaaataaggaaagtataaaacaaacggataacaacagtagcttggagacagcaaaggcacccgagcaggcgtggaaacacacgatgcatttgaaaaaggggaagaggagtattagcacagtatggcgacttttatggaagcgtttttattccgtaaactctaagacgaatatgcatttttctcgaagtaggaagaaaccagtgacaaacttcacaaggacaaacggacttctcctgagc

SEQ ID NO: 14002 - DNA, 453 bp, Saccharomyces cerevisiae
actgagagttattcttcttcttctcccacagtagcgaaagaggatatttaggtagtatacagatttaaatgtagtaaggaaaaaaattaaatattggccatctgttttaggcatttcatgtggacaacataagccttttggactgtttaaagtaggttaacgtagagcagaaaaatatgagaagaagcctgtaatttgtatagtcaagcatatatattacatgagtttggtgatcagcttaatttttcagtattcaaaaaaatgcttccaatcggatttgaaccgatgatctccacattactagtgtggcgccttaccaacttggccatagaagcagtttttgatgtgagagtcgcgtagcgaatttgcttatacaaatgttaaggtaacttcagatctaaactcaaacttgtattttcctctatatttatctcatcttggattgtggtttcc

SEQ ID NO: 14003 - DNA, 440 bp, Saccharomyces cerevisiae
catatatgataatttaactgtatttttttcccttttctaatactttttcctcaagttatatttcggagctgtcccaggttcggaacaatgcggcatcagggataaaaaaaaatgacacataaaaacgaaaaagacacaaattccattttttttttttgacgcgaaagaatgacactactttcttctattgtaaccatttctaacatcgatattttacttgttagttcagatatatactaaagagtcacttaatatactgtttttgtttattatcttggttccaactgcttcatttaatatttcctatccaaaaaaagccagctaattctcttctttttttttcttattttgccattttcaatattatcgatttagtgaacacctggctagtcagttgtcttagcaaacatttctcaaaagaaagcaaaccagcatttgct

SEQ ID NO: 14004 - DNA, 408 bp, Saccharomyces cerevisiae
ttaagttgctttcctttctttttcttacctttcttcttctctaggattgaagcacttggagcaaaataaacaaaaatcaaaaaaactaattaaatatctttaaaatattaccgtacgaaaaaatttataccattccctactgaagtatgtaattcaaaatatatatatgtatatgtatatgtacatatatatgtatatactatcttaacaacctttaaccttccgagctattgatttttgatcctcacttcagcggctaaaaaaaaaaaaaacaccccgagtattagtgaatatagatatatatatatatatatatatatataggggggccgataaaaaagaacttgcaatattacgcagatcagggatttactaaaagaaaagtaataaaggactgctgcttccaaa

SEQ ID NO: 14005 - DNA, 401 bp, Saccharomyces cerevisiae
acggggattcttctttttgcttcccttactcacgaagctatcaaaaaacatgtaaatttaacaatgtgctctcactgtataacacagctatagctacattttattatatagtattttctccaatcgattaaataacggtttttacaatggtttggttcctgtatcttgtttattttgttcaaatggcaaaatacagaacacaggtataactttctttgtcttcttcatcaaagagtatcgcatatcaaacctttatgtacattaacgaactctcgacctatagtagcctcctggcgttcgttcagtgttattcttacgattggtctcacttttcataaaatttcacaagcttccatatttacgcgaggaattgtgcgaaagggctggactgagcatacgta

SEQ ID NO: 14006 - DNA, 450 bp, Saccharomyces cerevisiae
tgaataagcgcagagaaatctatactatatatgtatatatactcactatagaagaagcccgctctttgattgtttcctcttacggtgcttcaatgcatctttcattttgcgcctcatatcacgggtccaattacctctgttagcccagaactcctcatcccagttcgatagcattgtttctcttccaggagcccttactttactcaactgtgtttgtcctactaaaaatggcgattgcaaatgagggaaaaacaagaaatttttgttatctttatctctagatacatgtggtacgggagccgatgtcaaacctagggtgtcagatgatttacttacttcttcctccagttggttcacatcaacatctttcgcatgatcaatatcattatcagaatcttcaatcaatttgaattgtgatacaggttctgcctcgttggggttgaataggtt

SEQ ID NO: 14007 - DNA, 420 bp, Saccharomyces cerevisiae
gcatttctccatggttacaataaatcactgaagaacaagaaaataataatattttataaaaatattttactaaattacatatggtatctgcaatatttattttttaatcttttagcttcccgtccttttcgctgtgaaaaatataaaatccagcaaaaaaaaaaaaatgcgatgagcttacaagactactgaacttacttacgaagcctcatcttaactaaagatagccagtccacagctgcagaatattgaggcaatgcaaaaaacagatggtattagaattccaggcgttattttggacgagttgaagactcttgactacagtcaagatgaaaggttttctatttcagaaggaaaaaagagaagacgaggaaatggcaaacatttaagccgtaaagaaaagagaaagatggaacgggc

SEQ ID NO: 14008 - DNA, 500 bp, Saccharomyces cerevisiae
cctgtttccaatgctcgttataaatacgttgtagactataaagctgagttgtatgctgcaccctaacgtgcatgtatatataatcacagtctctttaacctaatatgcaaacgaaaatgatttaatcaaaacaacctcatactctatgggaataatctttcaagataccggtcatatgagtgttagtaatcttaccctttctttgtctcttctttttaacttcaactctctttgtttgtcttttgatagtagcaggatcgacactagcaggctttagacctaaatcttgcagctttcttggcaattctgcaaattgcggtaattgcacattttcccacattttaacaaactcctcgtcaatacatttcaagttaccaccgctgttataccaaacgtatcttggagttttatcctttttagttcttaacaccaaaattttgctgtcttcctccagttggttaatcgtttcatcgcattgtggccaaccgtctttcaagtct

SEQ ID NO: 14009 - DNA, 495 bp, Saccharomyces cerevisiae
tttacatagtttacatttttacgtatatgtatagatgatttcatgataaacgttttccacttttctatcatttcatcatctaaatgggaatagcaaaccctgggagttctttgtcgcactattttccaagcgtaaaaaggcatacttcaatttttcttttgtttacgtttcaggaagtcaacaaaacttgtttacttataaacacaaatacctacaggcactaaagtttgttttttggcctctataaaatttccctcaatgttgtattctctgcgtgtacatcctcataatcctcgttttcttcatcatcaaaattcaaataagtgtgatcacccatcgctcttggttggaagattaatttaaccaaaaaaatgatgccaaataaggcgcaaagccctgcaacgatgaggtacagtacgcctagtgacatatttctaccaccaatagctccatttgtagtcagtacaaatgattttgtgccaccaaagagtgaaa

SEQ ID NO: 14010 - DNA, 419 bp, Saccharomyces cerevisiae
acatatttttgtatattttattgttgtagttcactattattttattgttagtattttataagtggcgcgaggacacaatagaaatggagggaagatttttgctcgatggcaataccaaggatgactgaggaagaaaacaataatagactatactcaggcaaacatgcaagtagaagggcctgacactaacttcgtgagtgatttggctttgggatcaaagaaaagaaggttatccaagacttctgtacaagaggatgatcatacaaatgtggtatcggaagtgaataagaataagaagaaaaaaaaggcaaagcctatgacatgcacattgctaaagtctgtggttgaaaaaggtattggtataaaggatgtaagagacatgactcaatacttgttgcaggctgaaaacaactctccca

SEQ ID NO: 14011 - DNA, 431 bp, Saccharomyces cerevisiae
cttcgtgaagattcgtgtagtatgatagaacattccagaaaaaaaattcagattcatcgctctctcttcgcttctcctcctttaaggaataaagaaaaaatcacatacatagattaagtaaataggatctgctagaaaaattatatatagatcaatcatcttattaaggtatcttgtttaagcccaaaagtctgctcccaaattcctcactgtagctactaaaacaacctatacgcaagaaagatgtcattgacagccgatgaatacaaacaacaaggtaacgctgcatttaccgctaaggattacgataaagcgatagagctcttcactaaagctattgaagtttctgaaactccaaaccatgttttatattctaacaggtccgcctgttatacttctttaaagaaatttagtgacgcattgaatgatgc

SEQ ID NO: 14012 - DNA, 411 bp, Saccharomyces cerevisiae
tgttgaaaacaggaaataataaacagtatagtatatatatttatgaagaaccgcttagtattgagtaagtaaaaaaaaattgcacaaggaattaatatatgaggaaactactagtcgatcagataagatattatgaccagatatgcaaaaaaaagggggcgagctgggaattgaacccagggcctctcgcatgctttgtcttcctgtttattcaggaagtcgcccaaagcgagaatcataccactagaccacacgcccgaattattgttgcgttaataagaaaaacagaaatatttatataggagagtgattaaagggaatcttctatcaacaatatccattcaaattcaggcgcataacgtgagtgaatatagaattgagcctcctattagtcttcccgatttcattcga

SEQ ID NO: 14013 - DNA, 464 bp, Saccharomyces cerevisiae
tgaatacaagccattgaattactatcacttttttttatttgtatatgacttgtaaataaaccggaagagaaagaaacttatatattaccactatactatactatacttattgctattattattattcattattagtattataatatattattgatattgatattgatattgttattgttattgttactaccactgttactattactattattattgttgttgcaccatcaaaacccttcaagagcctttgtagctttgtctaatcttttcagtccttcttcatagcggtccggatcaagaaccatgtctgctgttaacctggacaaagagtctactagtctctccagggcacgtttctcctcaattttcatccccagttgcgcaaattcagacccgattaaggttccctttgtcacactcaacagttgatttagtgtgtcgatatcaaaggatcgcaattcctt

SEQ ID NO: 14014 - DNA, 402 bp, Saccharomyces cerevisiae
atgacgtaagatatatacgcagtctctcttaagaagcatacttgtatatggaccagcagcttacatagaaatctaaaagaagtaaataaagaacattagcaatcaatcctgccggtagtcgcaacagctccgattttgtcacgcagcgttcgttttttattcgtgatcttttaccctcttcgctatcgttcttatttctacataaatggaaccccgaagagcagaaagaccgaaaatcgaattactatctgtgggatacaatatagcgcatagaaaagaacaaaacatagatagtttggaaaaatagtacagactgctgaattaactccacttggtgcttttgtatatatcgaatgggccaaaaaagtagtaaagtgcatataaccaaaacagatagggcga

SEQ ID NO: 14015 - DNA, 405 bp, Saccharomyces cerevisiae
agatgatttatatcagcatatacctacataaacaaataaacatagcaacggtttagcaacatcgtttacagccatgtgaggcagttacttctatcatatgtctggctttagtattgttgggttgacacttatacgaaatatcagaaagtgaaaaaaaaaaaaggaaggatctagtgatgagataaacgaatttgtgatgtaaatgcagaagtaggcacaagtgcttggcagttttcaaacgatcatcgtattttaagctacaatcaccaacgccaaacatccacttgcagccactatgtcacagcaggagaatggtgatgtggccactgaattaatcgaaaatagactttccttctcaagaatccctagaataagccttcatgtaagggatttgtcaatcgttgc

SEQ ID NO: 14016 - DNA, 425 bp, Saccharomyces cerevisiae
tatctcacccaaataatttcatacatgcacatatagctactacatagtcaagaacatatcataacatttggtataacagtctttatatcagtctttgcatggctttgcatctgatgctggctctaccgacttctcggcgataaaataccaaaagaatttgacgtatatactatccaaagtggataaatatttgagttccaatgaggtaactaaactagttttttaaaacccagcagaaagaaaaaataccctatatttggcagtgctgtccatcagaaccattaactgcatcaataatagtttgggtgctgctgattatcataatcatgaaaccaaagcatatacaaagatagaaaggaagcctttccttccaactcttcttcttactagttaacaacaaatttgtgtatggcggcaaaatgtaa

SEQ ID NO: 14017 - DNA, 496 bp, Saccharomyces cerevisiae
agcatataataggaaaatagaaacgaataaataaatgaatgagtgacaagatatatttcaaaaaatttcaaatgattgacgaaagaaaatttgtacattttgtatgacttttaatattacatagtctattatgtgtgagagcaagttttaaactttgctgggaaacctttttctaaaatcggcttctaaatcatctacgttaacatcaacaatagtttctgtggcttcgctggaaattctttcaatcggcagtttctttgattgtaaacgactaaagtttcttatcttctgaatttctgtccttaaatgtagtggttttggtggtggacgtggtggtcttgatttatctttaccgttgcttttcgttttgatgtccaaaacaccatccttaagggttttcttaaacttttcttctgtgattggtgttattcttacacttgaatgtcgattggaagtttctgtaccaatatctgtatatttaccatacccggatgcg

SEQ ID NO: 14018 - DNA, 435 bp, Saccharomyces cerevisiae
atgaagtctagcacagggtgggagttttccacctattttctgttgataaaaatactacatttatatacatatatacaataatttctaatatcgtttttataaagttggccttgtctgtacggcgtcgcaaaacaagaacccctggtccaattgatctaccgggcattgattttttttcttttttccttgcgcctcacttcaacacatcaagtaaacaccagctatatttagttgctaggtattctccaacgtatgtggagtcctttctttattatctctctacacaaataggcacaagcgtaatgggctcagaacaagccttaagtgaggttgtcgaatctgctaaagagcggttcggcaggcttaggcatttagttcagaagtttcttgatgatgacgacgtgccacaagagtgtctgcctttgctccaagaat

SEQ ID NO: 14019 - DNA, 431 bp, Saccharomyces cerevisiae
tagatagcatctcttgatcctaagaactatatactgtatttgtattcaagatccaagataccgtgacatttcctatttgtcaaccattgcaataagaaattttacatgaatagtgcattaactttttattaccactaaagtagttttgcttaaatatacaataggcaaactagacttaggataattcacaagggtttttagtgttaccctttttccgtatgacacatttttcgaggaattaattattgggaaaatattgccgatcaagatccattgaggtgaatctaaatcgctccaactccaagttggggaatcttaagaccgtcactgccttccaattacactgcttttgtttctttgacaataagaacgcaaaagtaaatttcttttttttaacaaattatgacacatcctgtagcagtgaaggcatg

SEQ ID NO: 14020 - DNA, 424 bp, Saccharomyces cerevisiae
acaatcaagtatttttctattcactgcgataaaattgtgtttttcaacatgttaggtcaatggaaagtcattattttgaagcaaaatgtaaaaaaagaatattattaagagaataaattctttcaaaaatgtagagcaagttatgtggaaatcaaaagaatattagttgattctattatataataaatagttataatcattgtattttgatgatgaaaattcagtatctaagagttatagccaagagagtaatttttaatacttttttgcgcttttccatatctcattataaaaagaaaacattaattcatagttccatttatcatcatagcatatctttaaatatcatacttaaatagaagagattcacacagtaatagcggacaagaataatcatgaaatcagattggtatgggctgcaaat

SEQ ID NO: 14021 - DNA, 403 bp, Saccharomyces cerevisiae
gattagaggagacgttactttgtttatatatattagtatgtacaatcgcaaagaaatggagtgatgacatgttgtagtatttagtatgaggttactgtgtgggaggttttaccatgatttttggcgagaacacgccatgaaatgtctttgtacgaaactcattacccgcattaatattttttttctttttaaagctcagttgaccctttctcattcccttcttaaaacaactgtgtgatccttgagaaaagataaattacatacacaacataaacccaactacgatcgcaaattatgtcttggcaaggtatgtgaacgagacaattatcaattgattaagaaagaaatgagtcggaggttagcttgtgtgacaatgtttggcaatgcccgatttttgttgatg

SEQ ID NO: 14022 - DNA, 416 bp, Saccharomyces cerevisiae
gtatacttcttttttttactttgttcagaacaacttctcatttttttctactcataactttagcatcacaaaatacgcaataataacgagtagtaacacttttatagttcatacatgcttcaactacttaataaatgattgtatgataatgttttcaatgtaagagatttcgattatccacaaactttaaaacacagggacaaaattcttgatatgctttcaaccgctgcgttttggatacctattcttgacatgatatgactaccattttgttattgtacgtggggcagttgacgtcttatcatatgtcaaagtcatttgcgaagttcttggcaagttgccaactgacgagatgcagtaaaaagagattgccgtcttgaaactttttgtccttttttttttccggggactctacg

SEQ ID NO: 14023 - DNA, 440 bp, Saccharomyces cerevisiae
ttaatgcctcctttacctaacctactcttcttttgctccaaatgtttattctttttttttttattcagaatatcttcaagtttttttgtatctttttgtattattattaaacttctttataatatttgtcttataaaatcctatcataacatgactatggcttggcctagactcgggtgccatcttttttaatgcgactacttcaagacagcttctggagttcaatcaacttcttcggaaaagataaaaaaccactaattatcaaagctatcttgtccgctttcaaaaagtttattcgattttgttttcgttttcattttcatttttttattatgatggtcatggtggtagcggtggctcccttcagttttcctctttggtgctattaattttctcgttttccccatatatgtgatagaagcttttgaactccccactgt

SEQ ID NO: 14024 - DNA, 469 bp, Saccharomyces cerevisiae
gtgcaaaaatgaaatttgaagaatggaattaaaattaaatgtctctaagtataaaaactaaataaaatatagggtatctgtaaaccactaataaaaaataaaacaggaaaataaaattaagcaaaatatcgttgcgtataatcacagcatttctgggatgcgtccgtgaatgtccttaacttgaccaacattgacattactcttatttgaaaaatctactaaccttttcttacttggtcttctgtctggttccatgctatggacccagcaaaaattttcaccatctttaaccggaacaaaatcgtcagaagatgaagttgacattgttgtgggagtgattccgtttttaccgctttgagagtcttgaatattttgtaagtggcggttacgatgcttcgttacgttatatggtgatggtgttactgattttcttacgggagaagggctaatattgctgttccaagggtcc

SEQ ID NO: 14025 - DNA, 478 bp, Saccharomyces cerevisiae
gcgatcactagcaagccaaacgagcttgatgttgttttctcttagttatcctcttttttttttttttttcaattactgaatattaatgaataaattagacctcttttctccccaacccttttaatttctaataattaattaatttttcctgtgtgtgtgctatattcctactttgtatctgtgctgttcgattcctctgttggaacgatgtgatttgcgtgggcgttttatcgcaaaaaagttttgggcatgcgggcgtgaatggatgttgtttgccgtgtgtgggcaaatacaccctgctcttcgttttgtttgtcccgttctttcccatttttacctacctactatgtttttttttgagaaacatgtcgcttcatttgttatatattgttctgttaaagaattgtgtgtgtatttttttaataaaatagtatataatagtaatgttacaagactttagattttcgaagtgtcgcct

SEQ ID NO: 14026 - DNA, 482 bp, Saccharomyces cerevisiae
acacaccatcaggatcaatttactgcgcagtatgtactcgtacttgtatataagattcaaaggataccaagaaaatgctattacgtttaataacgtcgaagaacagtattgcactatacttgcttggtatagatatgtacaaaatatatgtatatacataaaatgagttattctttttcctaattctctttttcctttagtagaatataaaattataataaggattttgtgaacatctgacagacaggctcgttcgtgtctatttccattctgaaatttgaatgcgctttggcgagacatagatttgtgtcaaaatatgaagttgagtgcctttatgaggttgggttgaacatgaacaaccagccaaaataaaaaaataataaataagacgagtgccacttatatagcttgagagagagagagagcgtttgcacgtatatgtgtgacataatcagcgtttactcatcatcgtcgtctccatc

SEQ ID NO: 14027 - DNA, 400 bp, Saccharomyces cerevisiae
aatgacacatataaaacagagtgaagaataatcgtagtactattatgtagaaatatcaattccattttgaggattcaacctaaaattcatatgtttttcaatattaaatataaaggagctaagatttggcgtaggatcttcgtctataaatttagttgctgataaattattctccattgttgcttttattgagtattaaagcatttaatgctagaatcctccataacagacagcttcagtagctcagtaggaagagcgtcagtctcataatctgaaggtcgagagttcgaacctcccctggagcacattttttttcaaaactttttatcactgctagtaaaggtaatgaatgaaggacgttactgtagtactatactcatcatcattgtctgcattttat

SEQ ID NO: 14028 - DNA, 456 bp, Saccharomyces cerevisiae
tgatgacaaaactttcacggtaccgcatcgcgattttgaactataatatgctttgaagaaaattgagagatttagtcagcgttcatatgacctgttgctcgttctatttgagaaaagtgaaaaggttaatatatgatttcaataaagtatgtagtatgataataaaatacaaatttatatgggataaaattgaaccgcaagtaaagactggcgaacgaatattgtgcataagtagttcctgaagatgataaaatatggtttaatacaagttggtggttattgtgatttgtagaatataaaaaaaaaaaaagaaccttcatttttctttttttacctaaatccgtaaggattgttcagtgaagtagtagctcggggcaagtttttgttttgcattctcctcttataggcaggcttatatccttgtgttatcgggctttggtttggtaaaggattcgg

SEQ ID NO: 14029 - DNA, 452 bp, Saccharomyces cerevisiae
atactcatatatttgaaagaaacatatgtaagattgggttatttgcatatatatcccaatcatccataacatttaatgctactttttttttatttagcctctactatttttcttgtatattctcttctagcaacatatactactcaatcagtcttcctttttattaccatcaactttgtgatcttcagtatcctcgcggaacgctacaacaatgtaaacgattagaacaacattggccattgcagcagctaaacctccactaattaaggtatttggcgtaaattgctgaataatgaaaaaagtgagtacgggcagtaccaccatcgctgcagtaaacagcataagtttattaatcaccgcacgaggaacatctacagccattatttgattcttttgaagtcttggttagtttctactattgctttccagtattgcgttcattttagcttgca

SEQ ID NO: 14030 - DNA, 470 bp, Saccharomyces cerevisiae
gcttgaacttttgtacttagttattatcaaaataaccaataagaattattttagtcctttcgcaccgcgattattaataaactcaatatttttttcctatttaattccataaagaaacaaaaaaaaaagcaagcaactacaaaggtctacttaccatgtttaaacgttccatcattcaacagtcccgcttattctccaattctgcttctagactaggtaaaaaagtgttctttgatcctgcggtcaatggaaccaaaatcggcagaatagaatttgaattatatgataatgtggttcctaaaactgctgaaaatttcagagccttatgtaccggcgaaaagggctggggctataaaggtgtccctttccacagaatcatcccagacttcatgatccaaggtggtgacactgatttgactaacggttttgggggcaaatccatttacggttccaagttcgctgacgaaaat

SEQ ID NO: 14031 - DNA, 403 bp, Saccharomyces cerevisiae
taattttgtggatcttttactcttttctgtacataaattgccactatttaattattttctctacggtatcttttttagaacaaataactttcaattcttgattgaagttctaagggaagcaattcgtgcgcgagctcaaacatatcatcaacgttattgataatacccatatcgataaacgaatctaccaattcctgtttttgtaacgtgccgattttttgtttcaagaaatccattatatttaaagattcctcctgtatagtagaccacgtttgtttcggcaatattatcctattctcattcaaaaattgccttgtaagatgttttagatccattatttgcagcggttttatagaagaacgtctcaccgcagggacatttaaacggataggatcgttgccta

SEQ ID NO: 14032 - DNA, 449 bp, Saccharomyces cerevisiae
gaaatatacaaacacatatatactaactataggcgtttctattcttttggtttactgtcgaaaataaaaaaaaagctgttgtggcggcacttcgtaagttttcaattatccagctactgccagtagagtactcaatacttttactttcagctgaaatgaggtttttctttaaatgaagttgatacgcaatatcataaaagcaccggaataatggtaatcaagatgaagcgctatgatatttttagtatttgccatcttcaaatcattctattttacccaatagaacattcaagtaaggtgaactatttaaattaaaaactcaagtaacatgggcgatctttaagcatttgagagttattaaaaatttccgaatagagcaataatggaggaaattaagtaaaaactttgagccaaaataaataatattacaaagcaagccagagtctctt

SEQ ID NO: 14033 - DNA, 404 bp, Saccharomyces cerevisiae
aagtatcgttaaacaaagcttttcaaacgtttttgaaattttttgctttctatagaggagtgtgagtatatacaaaataatatttagatatacttaaaatgagcatgctacacaggtatcttccaaaacactgtcataacgaaattcttatagccgttccataaacgggaacaatatgggggcaaagtacggctgacatatgcatccaacctaaggacatattgtttaaatatctgcctcatagattcactttgtaggtaccttaatttgaaaaaccatacataggttagtcctgccaacattgtacccactacctcaaacgacacgtttgctcttcttaccaacaacaagaaaaaattgaagggcactaagaagaggcccacacgtaggccgcagataatctc

SEQ ID NO: 14034 - DNA, 473 bp, Saccharomyces cerevisiae
gatcccgctctcacctagtacataccttacccgttagaaaatgcgataacggacacaatcttggcagaaacattatcaatactatgatatatatatatgcgtttccgactatactaatttttacactttttgaaaattttcacttctcctcataatcaaacgaggcagatttccctggactgtatgtaagaagcgtacaccgagttccaaaggtcacaagcttggtgctctagctttgaatcctccgcgtcttcttctttaacgatacattcaaactccttcattgatggataattccagggcttggccaatggataatccgaaaaatgtatgtacttagaatatgcgacactgtcgtttaatcctaccggaatatcgttgccatcattatccaatgtcttataacccaaaacgtcattatagattatagaatagtgccgtgggtttctcaatgaacccgtcagtaagccgta

SEQ ID NO: 14035 - DNA, 494 bp, Saccharomyces cerevisiae
aagtgcttttaaaatttacttcattatttaataaatatgtgattttagcgtgtgaatataaaaaatacatagaactcaatcttcgttaacacggaaccatcttgtaatcaagaagcgagaagcggaactaaaactttaagaaaaggagctctacgaaccgtcaaagctaaattgatcgatagaaattgcttcttgaaactttacattctatgtactttacaaatatactttacaaacttagccatttatattactttacagttaaaaatccatcaggaattattcgtctgctttttgagattcatggctagcgacatactcagtagctttagctttaacgtattcaatggtcttttcgtcaccttcagattcctcaaattgtaaccatttattaaagaaaaacttagcctgcttccttgttatttttttggttattattctctcaaataaatcttccaccttcttcttatcttttgccttcacttcctggtcta

SEQ ID NO: 14036 - DNA, 497 bp, Saccharomyces cerevisiae
tgtgaataaacgtatcttaaggagaatacgtatcatcatatgatttcccccctgtatgaaggccaagttaacatggtatagctcatagttgttgttataagaagcataaacccaagtacgaaagtaataattctgtaaaaaaaaaaaaaaatgcgtttatttagcgtcttcgggttggctatatatatatatttaaggatatatgggcatatgtacaagtttaggttaacaagccaaaagaaaataaaagtgttcatttttcgttatttctggccaagcgattttgcaagcctctttggccagctctcgccaagactcctagtaagaaattgacagatctcaatgaatcatcgttacctgggatagggtaggtcaccaaagaaggttcggagtcagtatcgatgattgcgatagttgggacccttgatttaattgcttctaacaaagcgtttctattttctgtgggatttaatacgaccagcaagtcaggcttaacc

SEQ ID NO: 14037 - DNA, 422 bp, Saccharomyces cerevisiae
gccttcaacacactattctaataacaatcctaatgtataacattttttagcattcaaacattctcaccatcgcgctgagataattttatatagttgatggaatagttttggaggtgatttatccattaaatacctgatgcttttttgtctcctcatcgcgtgaaaaatttgagaaaaagctcgaactatttgtagcacttcactgtattgctaacagttcttaaaaacttcagaacatatagatattgctaaacacagatttgaataccatagtaactagtctcttattcttagtttttgatgagctccattcacgaggttgtggctcttattgaagagctgtactctcctcatccgaaacatgatgttaatcagattcaacagagtttacagtcaatccagaaatcagagcaaggcttcca

SEQ ID NO: 14038 - DNA, 478 bp, Saccharomyces cerevisiae
tctacccaatagcttctttgaagaagtaaataaatataaatagagagaaatatgacgtatcaatattatttatggcgctggtataattcaatagcatctaatagcgacttggggtccggttttggactgaccacatcagaggttacatcattatcatccagatattttttagtggtaggtccgatggacgcaacccgtagatgggaacctggtaggcggttactgtcacccaaatactgagtaatttctttcgttccctggggactgaaaactaccacccagtccgagaatacttcatcctcatcgcattctttcatggcgtgtatgaatcttttaaaaccgtcgcttaattcttcagttttataagtaaccacttctcttacttttattcccttgctatggagtttctttgggatgatatctcttctaatttcacccacgagaaataatagttcacttggtgggcatgccttaatat

SEQ ID NO: 14039 - DNA, 491 bp, Saccharomyces cerevisiae
taaacattaaatacattacacgtagccacccgctgtatagcataaaactaacttaaaattattcatatgcgtttcccggggccgaagcgttattgccgatattcggtagccgattccgctggctttttttttttgaacgaggcaaaaaagtttcgtgactgaacttcttcgtcactggttttgttgataatttttatcgttttttacttcgagattgaaaacagtgttctgaattttagcaacgatatcgcaccgcacgtttagcctgatcaaaccttatatatacctctaccttaaaatatatatatatatagtattcgaattccgaattgtgtgtctccgcggttagtgattgttatacacaaacagaatacaggaaagtaaatcaatacaataataaaatatgacaatcaaggaacataaagtagtttatgaagctcacaacgtaaaggctcttaaggctcctcaacatttttacaacagccaacccg

SEQ ID NO: 14040 - DNA, 461 bp, Saccharomyces cerevisiae
cgctcttgaaaaattctaaataagatttaaagacgtacatatcgtacaatctggatactgttttccaggacaactgatagatacaattttggcacatatgaagtatgtttctatataacgggtgagaaaatcgctgtaaattcaattacgtacaatcaccgacgggtaacttatttttttttctttttctcttgtagttggaaaattttttgaagctcatcgcattggaaaagaaaaattactagcagttgtgatgatttaactatgttttgaggaaccttggctttatcttttatttgtcgcctggtacataacactacattttattgtctaataaacgttgaggaatttgacaaaaggatggaattcacacctatagatccgcaccagcaccaaaatgctgctactcttctatgttgtaactgtggtaccccaatcgatgggtccactgggctggttat

SEQ ID NO: 14041 - DNA, 434 bp, Saccharomyces cerevisiae
tgaacccgatgcaaatgagacgatcgtctattcctggtccggttttctctgccctctcttctattcactttttttatactttatataaaattatataaatgacataactgaaacgccacacgtcctctcctattcgttaacgcctgtctgtagcgctgttactgaagctgcgcaagtagttttttcaccgtataggccctctttttctctctctttctttctctcccgcgctgatctcttcttcgaaacatcatgaataaaaagaaaaaggaaatcaagaaaaaaaagccataatttgacccacatttttttttattgtcgctgttcacaccgcataacgaagatattggctacataaacaattgacattggatctctagttttacgttgttttcaactgcatctttttcttctttcttagcacggagccctta

SEQ ID NO: 14042 - DNA, 484 bp, Saccharomyces cerevisiae
attgaatagtgatgttatgacctttttttttacgccttttttttttttttttttttttttaatttatctcacttttcccttctattttatgtactaacagataattttataatgatttcatgtatttttggttcagaattttgacaaggcaactcttgaataattgtcgtatgcaaaaaaaattgtttatctgttacatatccatcataaaacttttatagagcttttattgtccttcttatacaaataccgttcagaggctgtccgagatttaagcggttttggaaaaattactgctattaattaagattaaaaaggaaaggaaaatagcaatgggagcttatcgcataaaaaaatgaacaataatgttgaagaactcctacggcgtattcccctctacaacaaatatggtaaggattttccacaagaaacagtgactaggtttcagatgcctgaatttaagttaccagcgctacaaccaaca

SEQ ID NO: 14043 - DNA, 424 bp, Saccharomyces cerevisiae
gaaaaggactaacttttcatctaaatggattaaatacctgtttaaacattctgtaaatatttaaacataaacatcaattttattacacaatactaaattctttcttttcttcgtgaagtatgtatgtgggaaacccaagatggcggaatcgcgtgtaatattatttatcatatgccttttttaggaaatctaattacttaccgaagaaaataggacaacgaaaaatttcgagaaacgaaaccagaaagtaaatggtgaatatcctataatctacacattttggtacagtttacttaataatactccacacacctctttgcctcttttctaagaagtataacacaactacaatataagtgatgtctgataatagaagacgtagacgtgaggaagatgattcggactcagaaaatgagctaccgcc

SEQ ID NO: 14044 - DNA, 481 bp, Saccharomyces cerevisiae
attctcttattatatattattctcggagtttttaagtgacatcacccgaaaagaagctaagtctttctcctaattcatatttaattattgtacatggacatatcatacgtaatgctcaaccttaagctgctgcggagcttccacgagcaccagcacctgaagcaactagacttatttgcgcttgagttagttctatacttggcagtggaagtttgtcattatgagttggtggaggtaaaaatccaaccttgtttaaaaatgcaatatatataccaacctcttctggagtaacacctattccattagaccaatcaacacctgtccatgcggtgtctttctttaaagatgccacggcgttcctatcgtctagttccggagctttggtactttcaggtaagttgtctaagaccatgtgtagcaaaggatacaacgcattttcttcattcctgtcaataacagacgcctccaatgatttcttcca

SEQ ID NO: 14045 - DNA, 455 bp, Saccharomyces cerevisiae
ttatgatcgaatagtctttaactagagacttattttaaacaggacatgtgttttttactaatattgtattcttcgatgtagtcgttatagttctttttcttcaaatcatttaaataaagaaactattttttctttttgtgtgtagaataataaatgtaattctagttcttcctttttttttttggctttttcacagctcatcttttttacccatttggtcatgattatgttgtttgccgttgtgcaatagggagtttgtaaatcctgagataaagtatggtgcttcgaggttagcacttaattggcgtaagctgcttaatgacaaaaccctccttgggcttggcgtatacgaaatatgctcctgcgaagcgcagtggcaatattgagcactatgttaacgataacgtgttggactcatcgtctgtgcacatatgattgaaatcgggaatcctctg

SEQ ID NO: 14046 - DNA, 458 bp, Saccharomyces cerevisiae
cggcgttggagcctaatcaaatatcagtttctacatatatatatacttcgtagtgatgatatatcaattggagcgtccttgcataggcaacgcctatttggatagtcttcaatttcgaccccatttcacgtgaataaagcggagctatctctgttttgcaagggttcggccgattttgctgcgaaattttaataagcgcatattgattttttcaagcaatactttgtatattcatgatcgaatgaatgaaaaagcaccactcctcagccgcataccttcagtatcgtatttatttccttctttaatcacttaaaatgagcactttagatattgcagaagacaacaaaataaaaaatgaagaattcaaaatttggaaaaaatcaataccctcattataccaacatatttcaagtttgaagcctatctttggctcaggcgttgacgaatctccatcgaca

SEQ ID NO: 14047 - DNA, 462 bp, Saccharomyces cerevisiae
ttaatggatgccttcaatgagttccacgacgcacgtttattttttcgactgagaatccctcagcaaatataatctattttttatatatctgtgtatatgtaagcatgtataactagttacaaatatgataactgctttggcgatcacttcattttcttgagaggggtactcagtagccgccaagcacgaaatgtccgttattaaaaattggggagtgaatcttaaaagcccgaaaaggaaattcaaaatctgtctatttataggccgtcgcgctctacgaaaacgcgaaattattcaaacggaaaacggaaaaaaatctaaaaaaagaaattaattgagagatctcacggaaatgccgcgaggaatgtttctcgaggctgagcggcgtggtctgtgcaaaaaaatggcaatttttttgtaggagtttgcattgggccattcagaaggagcaccgttagatgg

SEQ ID NO: 14048 - DNA, 405 bp, Saccharomyces cerevisiae
ttcgggttttaatttaagtgttttttcgcgcattagcgcttgcttttccttcgattttaattatcagcctaaattattgttgtctttcccgaaggatagaattgtaaattatcagcgccgtatcgtatacttgtggtgataaatatctttaatctatttatgttttttttttttttttttttcgtgtctggtttctacatgtttgtgaacgttctgcatatctttatgtacgtacacagtatgttagtatgcacttatactatacaaagaataagggaggtgaggttaatcaataaggttaacgtaaaacatttattattttcatcaccaaactgttggaagttttgaattggttaattatcaaggatttcattgttagccaaattttccttggcgagatcttgt

SEQ ID NO: 14049 - DNA, 466 bp, Saccharomyces cerevisiae
acagcttaatcaaaataaatcaacaatctattagaaacaaaaaaaaaaaaaccagcagaaaagaacaagttaccatactaattaatctcttttaattaatgcgtggacagataatcatttctgttccctcactctgaaaaaattgttttattttcctattttttttttcatctattattgtattttgccctctcctcactccttactttagtctattatcaatatctcttccccctcctaaatatgtactcttttattttttttaattgtgaaggaacaattcaagttagaactcttttgataggaaacattatttcctgtgtagcctaatgtttaatgcctaatttttttctaaaatgcagcaacatacatatgttgagtcgtatagacatctatatataacaagcacagaaccgtctaattggtatttttcaggacattttaaacatccgtacaacgagaaccc

SEQ ID NO: 14050 - DNA, 479 bp, Saccharomyces cerevisiae
taggactcttaacaatgcctaaaaaacgccaacaaacctctcccttccccccacccaccaaaaaataccatagtaatgaaaaaactaaataattcatattatataacatagtattaatatatgttcgacaagaatagttttgtccacgcctctttcccagctgatgcggaggaagtgcttttcgccatgttattaaccagtacgctagcttttgttcttaattaaagaaaaaaaactatctccgttaaatgagcaagtattaaagaagcattctttcacgacgtgccacagagaacttcccgtcttcattcaccatgaacaacaagctcatatatcgttcggttagatttgcaacccataacagccagcttttacttccacctttggttctctacagaaggatactaaggcagcataagctgctacctggtccccaaagggagatgggtgaccaatacgtgcgaaacgagttcaagttg

SEQ ID NO: 14051 - DNA, 445 bp, Saccharomyces cerevisiae
tgaaaaccattcgttctttctggtcgtaatacaaatagaagaggtaaaccaatcaatggcccgttagtttgccatttgctgcatccttcccatgcaaagtgtcttcgtatttagtgatgttttgttagcgacacaaaagagacctcgatgacagacatttttttttctttacttaatgtattataagtgtgtctgacctcgactatcattataatattaatttgaagttctattttacatttatatgagttattccattacataataaggatatcaagagcagattagtgtcttttagattatacatctttttccccccttttttgttgttggtagtggaaagaaaaggatcaattaacagaaataaataaataaataataaaaacctaaaattccttttgcgtcattgaatttttattatgaagtcaaaagggagtcggttgtc

SEQ ID NO: 14052 - DNA, 445 bp, Saccharomyces cerevisiae
cgagatagcgacggggttcttaaatagtcttctatctgatgctttcgtactcttcaacctgtccgcttttctcattgcaaatattccactataaagttccttttaagaggaaatcccttttattctcccgcttttttctgtatttatgtaacttcaagatttttttttctatatttgatataaactttaatagggttcttcttttcagaagtttatcaattgcttaagcctccttttgttgatcaacaacaataaaggctttattatcgtaaattttcctacagcatttattcttcatagagcataccgttataatttcaccgtcttttcactacgctcataaagagagtacagttatactgctgcaaccctagcatgtatcaagctgtgctgcttatacctattttgaaagggccattccttcttttgccattcctttttcgtc

SEQ ID NO: 14053 - DNA, 487 bp, Saccharomyces cerevisiae
tcaaatttatattatttagtcgtacatatataccagcatatgaatataaaatctaagctttttcaagcttttaagtccaacttttctataataataccatattttgtgcgcggctcttgacaaaacaaaaaaaaaaacctaaataaaaggaaattaagaacagggaactaggtttggaaggacaaattcaggaaggaaagaaatagctgtgacaaagtaagatgaaccaaaatggtgataagaacgaaggcaagttgtttcaactaccgtcattgccgccctggaaaacaccaaggttcaacaaagccaactttaacaattttaccacaccgctacggaaaaggtcgacaagggtaataaatgatgattcgatgcccataacaggcgaagtactagaggagaggactgcagatgatctctatgggataaatatggacgtagacgaagtcgactatctgaatactttgagccacatcgaggaagaaaa

SEQ ID NO: 14054 - DNA, 462 bp, Saccharomyces cerevisiae
aggttataaaacttattgtcttttttatttttttcaaaagccattctaaagggctttagctaacgagtgacgaatgtaaaactttatgatttcaaagaatacctccaaaccattgaaaatgtatttttatttttattttctcccgaccccagttacctggaatttgttctttatgtactttatataagtataattctcttaaaaatttttactactttgcaatagacatcattttttcacgtaataaacccacaatcgtaatgtagttgccttacactactaggatggacctttttgcctttatctgttttgttactgacacaatgaaaccgggtaaagtattagttatgtgaaaatttaaaagcattaagtagaagtataccatattgtaaaaaaaaaaagcgttgtcttctacgtaaaagtgttctcaaaaagaagtagtgagggaaatggataccaagc

SEQ ID NO: 14055 - DNA, 457 bp, Saccharomyces cerevisiae
tggacctaaggaaagacataatattggtcgtccttctttcccttccaaccttagttggcgccatgtgtgtatttaatttaattcaaaatatcattctgctgcgctacttctgtattattgctttgaggaatatacgatgcgttgtactatataacaaaagcttcactttataagtttctataactggatagtttggttgtctcactctcctgcaaattcatactcttcttccatacattaacatgccgtcctaggtgcttgcttttttaattagactggttataatatgtgtaactaagccattttcggggccctcagattatattaattccgaatcggtagtaaacgatattttatgaaaaggaccccagggcgccaaacaaaacgtggactgtgacaaactctgccaaaagtcaagctctaatcgtgtaaatcttaccaattgagagcgattcct

SEQ ID NO: 14056 - DNA, 448 bp, Saccharomyces cerevisiae
gtttaggccattggcagttatatataaaacacacacgcacacatatatataaatgcagaaataaaatcaactatcaacaaatattgtcaaaaatatacttcgcaactttaccattcttataaacatcattatgcaaacccaaatcgtccaaatacaacttgaaacttaactgataatcctgaagacaagaaattaaacaattagtttgtcttaacgttaataactcgtcgctataagaatgcactaggtgcatatcaatactgaagcgagaaagggctttcttcacgtaaggcattactctcgagggctcttcctcgtacatttgaataccatcagggaaggcaagtcttgtaaaacaatcatactctgggtattctaccaacagttcctttaacgagtatataccatccaatagaaatactctcttcacgatctgcaaaagtcccaa

SEQ ID NO: 14057 - DNA, 488 bp, Saccharomyces cerevisiae
aaaaatctgcctttctagtcatccaaaaatagccaaatgctacactaaaccaataagcaaacgagtacataaagaataagtaaataataattcaacaatacctgattttttttttcttacattttttttattattcattaaaagcaaccaccaagctttccaaattatgaaaccttgataaaatggcttcaaaatcttgatctggaattccgttttttttgaagaggtcgaaaattatttgcttgattagaatttcaaaatcaataaactcgtccatatccacgctgttccgtgtcaaacgctggttagctttaaaagctagaaaatattgattgttttcaacatatcgacttctgtctactggtgtaacctctgtaataaagtagcgggcacccgttttcgatggtccatttattagatctagtgacctctccaataagatatcccaataagctattgagaatttcaagcgcgtgaaattcaaattt

SEQ ID NO: 14058 - DNA, 406 bp, Saccharomyces cerevisiae
ttgtacatatgcggcatttcttatatttatactctctatactatacgatatggtatttttttctcgttttgatctcctaatatacataaaccgagccattcctactatacaagatacgtaagtgcctaactcatgggaaaaatgggccgcccagggtggtgccttgtccgttttcgatgatcaatccctgggatgcagtatcgtcaatgacactccataaggcttccttaaccaaagtcaaagaactcttcttttcattctctttcactttcttaccgccatctagatcaatatccatttcgtcttctagcttagcgcttgcgtcaaccaataattttctctgtgtagcatattttaagtttctctcgattttcttagctctctttttggaaagtgtcctcgtggt

SEQ ID NO: 14059 - DNA, 406 bp, Saccharomyces cerevisiae
tatctcagtataatcatttgtacgttcataagaaagaatttcggacagtcttgagttttttggttttagcatcgaaaaagttcacttcaaataaattttttttttatcattgaataactctttatttttcacgtcaaccaaatacatctcaaaagtctactatatattgaaaagtatcatacaattagtgtaaataagtatcttaattatgggtgaaaaacgtaaccgtaatggtaaggatgcaaattcccaaaacaggaagaaagtatgtctgtctgcacacgaattagagttctttaagtactaacgatcaaaagtaatagtttaaagtatcttccggattcttagaccctggtacgtctggaatatatgccacatgttctagaagacatgaacgtcaagcagc

SEQ ID NO: 14060 - DNA, 400 bp, Saccharomyces cerevisiae
cttacctttcataatgtattatcacccttttacataatacaagttttagaagcagatatttttatttttttcatttccattgttcaaaaagagggatggtaaagtatgctaaaaggcatacaaaacaattaaagggaaacaggtacagcgaagtcttatgggattcataatgttgttaagatctagatttttgaaggttattcatgtgaggaaacaattgagcgcctgttcaagatttgcaattcaaacacaaacgagatgtaagagcacagatgcttctgaagatgaagtgaagcatttccaggagctagcccctacttggtgggatacagacggatcacaaagaattctacacaaaatgaatctaactaggttagattttgtgcagaggactgtgagg

SEQ ID NO: 14061 - DNA, 442 bp, Saccharomyces cerevisiae
taggaatacaaaagccgctgtttacacatttataaactacacagcagactccaacgcaatttatgtgtataaacttacataatgtcatggctatgtacacacgattagtacgtatagaaatgcaattgactcatctttattgcagacattacatcatattttgttgatattatagtaatatgttcatttttttatttatctctatattaaaacaaaacttttgcactaaaaaaagaaatagtacagattcatttttttttttttcatctcaaaattctctcatcaattcttaacttttttgattggtttaccactggcaaaggtagcagcaacaatcaatggaagaacagtggtgacatcagcaaaaagtttgacggatttggcttcagccttgatcttaccccaagacacagcttcgtcaggtcttgcacctgcatcagaa

SEQ ID NO: 14062 - DNA, 476 bp, Saccharomyces cerevisiae
gagaagaaacatacttcaaaaaaaaaaaaaagaaaaacaacaaaaaaacgtataaaatgaaataaatttcgaaccgctttttttccttttttttttttttactttgtttgacctcccctaactctttctttttaccttcacaattgtttattttaatatatgatttttaaattaattcaggttaattctaaaaactatattgcaatcttttaaatatatgtatacacgttcattaccacgtatacatatccatatatatatatatatatatacatactatttatgataaatttttaacaagcaaacccattattaaatgctataaataaaagacagcttctttctaattattattcaaacttaaaaactacatatacaaaaactacaaaaatctttcaaccgacccatcttctggcagatctgaataatctaatccatggaccgtatccaccccactcttcgtatttgccctctgg

SEQ ID NO: 14063 - DNA, 482 bp, Saccharomyces cerevisiae
tacaattccaacatgttcgtttcttcattacgatgttttcattcttaaattaagatattatttcgataccctctttactttcttccaccattctgttttcgctgccataattttgtaaggcagaaaactacccgtagaatacatattcatttacatattttttagttcttcaaaaattatcttttacctttttttactttattttaccatttttcttctagccctattttgaccatctgatagcttattcaagaacaagtaccggtagtattggcaccgcgccacttttccctctcgctttttttttttttctttttgccaagcgcctgcacgttcttttgtctggagtcttggaaaatgataaccaccaaaaatcatcccacggacggcttgagtaaaaatgtttttccgcgagacggaaagagacgtaacaaccttacatttttcctaaaagattaataaacctgatattgccttggcac

SEQ ID NO: 14064 - DNA, 468 bp, Saccharomyces cerevisiae
taactttcatcaagctcaacttttatgaatttttatttttaaatacttcgctcttacttatatatttaaataaaaacttttaagattagatgaaatgaattgtctcccttttatagctttcttccttcttttttgttctttatcttttattttttgttggtgtagcagtctaactttctacaatttcctgtgtaggttcgaatttgagtttatgatgggcagcaccttcggccacctgttgtttcctctttttagctagagctttagaggctttgatattgaatccgtcctttaaaattgtttgaacttcctctaactccaatcctgatagttctggataacaaaagtaacaaaaaatggttgataaacatgctacaccggcaaagaatgaaaatgtacccgttggtgtaatattttgtaacatagtcaagaacgtagacgcaatgactaaagaacctgcccaattgg

SEQ ID NO: 14065 - DNA, 488 bp, Saccharomyces cerevisiae
cgataaataaaaggcgtgtcagtattctgcaatcccggggaaaatattatatcatatcaatattcaatgatctacgtctatatagttacgtgtatacgccgtaataagcgctttttttttttttttaattttctgactactgttcagccatcaaggtatgtctaaattaataatattcagcattttcaacgtgcgcttaccatctgctaatacacagctcctctgaaagtttcttggccgaatgtcataattttcgaaccaaatataaaaattcatacacattaaaacaagatgtgcttacaaagcggataagttccgcagcagccaaagctgcattgagacatttttcgcatacacatcacttctctggggaatgaagcatccgaaaacgccaacgggactaaaatacagcaaacttgcattttggtcatttatggttagcaagtttaagtgctactacattacatattacctgaccctgaaaacgg

SEQ ID NO: 14066 - DNA, 432 bp, Saccharomyces cerevisiae
cacgccttttttatgcgagcttttttcctggtacttgtatgtattttgaatgtattttattgtactgaattgtattttattctaccgcacatttgtttcttttggcatatatagtatgtttacttaacaatagggatttccttcagttttcctagatgtatcaatttagttatcttttcgaacactttggttatgtcaccatggtcagatgaccatattattttgaaatccatataaccaattacaaagcaagcaacaagcgagtaaataaaatcgttaggcggttaccataacccttcgttacgacgctaaagtgctatataatgcctccattacggctgcgatagaactgtgcctaaattagcggcagaggttgaaaaccaatcatcactaacgtattcaatattaattgttgagaaaaccaactacgga

SEQ ID NO: 14067 - DNA, 443 bp, Saccharomyces cerevisiae
aaagcaactgtccccgcttttcacctggatacctaccaatttttctttttcttatatctttgtattgtttgtctttcttattactttttattctatatagtctttagttaattaattacccgcaacgatcattaacacctcttaaattgatctactcacaattgggttgttcttatacttagagaggtgcgttcctcgaaataactcgaatcaagcccacacctgctcccttttttatttctccgtcaattgcactgtagaatccttttctggtctcatgttgtggaaagtttctaagatgttcttgggtggcttggtagcgctaacaacaatatcggttgcgaccctttatcactaccaaaatcgcctagtctacccatcatgggctcaaggcgccaggaatcatgttgacactcctgattcccgtggaatcccttatgaaa

SEQ ID NO: 14068 - DNA, 471 bp, Saccharomyces cerevisiae
taacatacatagccaaaggaggatccaaatcatgtataaattggataaataaattgttttataataatttaatatcttgagaaagcgctcatatttacggttgattgctcaattccatgtaccggatccaactgtactggcttcctcagcctccggtaccaacctttttttgtataaatacgtaaaaatacaaaagtctgaactatttttccctttttatgcaaataaacactttcctatatataattttacttttgaatattcatgtcacgacccactgcctgagaactttccattttttataaagtgaaccaagttttatagttatcttgaatcaggtgaagttgaatgtgttaagatggatgattgattgttcattactgatgatggagaagttatactggcgacgttacttgaggatgcattattattagaaacttctgttgtggacgaaattatacgcggcaagga

SEQ ID NO: 14069 - DNA, 474 bp, Saccharomyces cerevisiae
caatttcgtttactgaaaatgctactagtatataatcattaagtatctaactatcactcaataaaaatattatagatcgcttaaaaactcgtttattgccgattataaatccaccaaaagccgctctacccttacctccgcctggaaaaattataatatataaagtgagcctcgtaatacaggggtaaaaaggaaagagggggatatcaagcatctggacttatttgcactatctccgccttcaattgataaaagcgtcttgattttaatcaactgctatcatgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcaca

SEQ ID NO: 14070 - DNA, 490 bp, Saccharomyces cerevisiae
tgatgcacgtgacacttgagtcaaaaggcatgtgcgcctcttgttatctttggatgtgtagattaaaggatggcaacgtagatataaaagattaattgcataaagttgtgtagatataaatttaactaaactttagaataaacgttttgagatgactatttttgaaattcctttcattcgtccaggcgttccattacaatatttcctgatggatatatgccgctaacgtcagatattttggtagataaatcaagctctcttcttggtaccggcgtgatcaatttgaagctatactggtgctgataattagcaggttggtatacgggtaaagtatcgttttctgagttcaacatgtcatgcaactgtaattctacgaaggcatatatctcctccgttggtagagatgcgtcaaactttctcactaatctctgcccattttctagtctgatcgcaactttgcttgcatctttatcagaagagggttcgggtt

SEQ ID NO: 14071 - DNA, 451 bp, Saccharomyces cerevisiae
tggctcttcgttggcctataaaggaattatcgatgaattatatactatacttaagaagtattttggatgagaatattaaaaagaaaggtgtcaagtaaatttcattatataaacggtttaagacatattaatatgcgatttttgggaagataatgactgatatcacatggctttgttgtttgaaggtgcttgttttatgctcataaattcaacacatcttcgtcgaagttaatagctttgtaatatcttggatctgaagagttggttgaaccgaacgcgttatactcaagtaatgtagaaagcatagctctagtgtttgatattacattctctaatgcgcattcgctatccttatgtaaaaatgttagtattgtgttgttactaacttgaaataatctctcttgtaagtattcgtcactcaaatatcctgatatctcctttggtgcctcca

SEQ ID NO: 14072 - DNA, 406 bp, Saccharomyces cerevisiae
cctttcccagagaataagcattgactcatacttagataatatagcttaataagtagttatataatcagtaaaaaagtacaataacaacttcgtacattttattgagtataaactgcagctaaactgcctggatgtgtcaattttaattgtgtttacaaaaagggtgccgtttattaattaatgtttcttccctgaaaatatggaaagtacaagtttttagttgagaagggtttaagaaagttttgaaaatgatctaaaaaaatataaaagcaatcaaagaaataaaagctggaaaaatgcgtaataaccgaagtgactaaaatttctttacgcgccaaataagaaatcgatgctcttgaaagtagcaaccattttttaaataatatattcctgatggttcttggcc

SEQ ID NO: 14073 - DNA, 492 bp, Saccharomyces cerevisiae
gaaaaataaggaatgatcggagtgttatcataacgagactggaacaaaaaaaactaagaatactttcccatccgcataaagaataatatccatttgtgttcgttatacaggaagtagaaataggctttataactttttttgtttttgtttccttttgtttttcttactactcataaacatattttttaatttttaaagtcataacgttgtatagttaataaaaaaaattggattactattcattgaagaagagagttctatacgttcttttttaagtttatttaaagggagttaccatttgtgtaataaagtaaattagagattatattatgtaaaggtaaaaacgggagcgagcatcatacggccttcttgctatcgcgaccaatggttggatttgattgctctttctcttcagtatcatctaatacttttgccagtcgatctcttgccctagattttaaaacttcttcatcggtcgaggaaattctttca

SEQ ID NO: 14074 - DNA, 415 bp, Saccharomyces cerevisiae
actatttttattaagagggaaaaaattcatacccaaactagattgaataacatttctttatattaatatattgtagttagagcccttttattttattttgctgcaaacataatatacacaaccataattacattgaaacttgacatgatggctggcatcctcatatggatatattttcaactataaaaaaaagtttgccacatacgtactccatgcatcttgttgcagatatgtgcctgagtgccaatttacctaggcggctgatttcacgtctaccaattcgacatcaaacaccaaatcagcacttggaggaatgacgcctgggacacctctttctccgtaggccaaagaacttggaatttgcagctttcttttttcgccaacgcacatgccggcaacaccttgatcccaacct

SEQ ID NO: 14075 - DNA, 486 bp, Saccharomyces cerevisiae
agatagaaacaaaacccctcaagagttatgtatatttatatacgcatgtatatgtattagtgcacgtaataaaacggcaacaaaaaacaaaaagttgacatattatcggtacttttattttcgtatcggttcaattatattatatgttagatatacaaagttttttatatgtaattattttttctgctactttaaagaaaatgtcacaaaatcaaataaaaagcttataaatcttcagtaataaaacccttgtgagaaacgtagataccgtccaaaaatttacggatatccttgtttctgacacgacagatttgttgcaagtcagcagcgttttgggaaacgtcttcgacagagttacctgacaagacaatttcgtccttaacgttggtggaaaattcgatagtaacaccatctctaactggaacgtttctgatcttcttgtcacccaaaaagtttctgacttcaatgaatttggcaccatccttt

SEQ ID NO: 14076 - DNA, 431 bp, Saccharomyces cerevisiae
atttactatgtaagaaaaaagtaatgtacacataaaatttgcaaccctataataaatcggattattctctttacttcttccctataagcaagtagatgtgaagccgcaattaattgagttgttgtgaaatggttctagttagtcacgtgcagctttttaaaaatattttaaaacattttaaaaaatatacatttttttattatttttttatatattaatgttaaaatttatttatgtatttgtcttccgaaaagtaaaataacgttcaaatttggtatttaaggatatctgcgtttaggcgcctagcaaaaaaatgccgaactaagaaattatattaatgtggtataagttactgtttactaaaagtgccccaaacggcgctggactgataagaatgaatacggattagacagcaggtttatgctaccctg

SEQ ID NO: 14077 - DNA, 421 bp, Saccharomyces cerevisiae
aaaaccttgttttatttacatacttttttcccacacgtgcttatgggccgcattgtataaataatccaataacgaaaaagagtgtaattgcagtccggtagtaataccatgtaaaaccttagatgagtttattttaagtacagccgcttcaagcatttttatttttattttacagatgtagcagataacaaccgttaaattatattatatatatatatatatatatatcaaatacgacgtattacatatatattgagaataagggaaggatggaagacaaatgacaaaaagtttgaagcataaatatgttcttcgcttagatgttcatcttggttcttctccagtttcttctcttagcgttgtaacggatagtgttgttggttctcaatctgatccattgtggcaatggtctgttttgctt

SEQ ID NO: 14078 - DNA, 453 bp, Saccharomyces cerevisiae
aaacttctaatattttcttacacacacatatatttatatgcatggctatacttcaaaagaggttgtcacttccatttccatgtaggtaaaactcgtgtatagacggaacacagacttccctagttttattgacttcatagtctctgcaccattcaattatgtctctgtaaaagagactcttctttatatcgcccttttctatattctccatctccagttctttgaagcatttgtcttttctcgatttatgacaaccacacggttttacactctcctctccatgttctaccatttcatgcctccagtcaaaaaatggttgactgtattccctacttgaatccatacttgattcaacaaggtagtttctcgaattctcaggtagtactgccaccctccttaaacgtttctctctttgtcttgcttcctttctttgttctatttttggcggaatgg

SEQ ID NO: 14079 - DNA, 429 bp, Saccharomyces cerevisiae
ctataagttttgttctttcctaaaacgaaaataatataaattatatatagttaatattaagcattacaaggtttctataaagcgttgacattttccccttttgattgttgccttacagtcccattgagatatataatgaatcggcctcctctagtgtggttagatcgaatgattttgactcaagaatagttcttgccatttcttgaaatttctcatcgtactttacttgcattattctccccgttcttttattcaattgcatcttcaattcttcttcgatatattctggtaaatcctcaaaggcatcttcgtaataagaggcttgatcctttatcgtcagatcatgcaaactatctacaaggtgtcgatgatctctcatttctctttcgtttgctgtcacagtttcggtttggcatacgagaaacctcc

SEQ ID NO: 14080 - DNA, 461 bp, Saccharomyces cerevisiae
tgcaatgatacgcttttgctataaactgtatatatcacaattagattaaatagccgcaagagaatgttatatattgaaatccattcgattatccaggactaaacaatgattttatttcacatttatttcaaaggacaactctttatctgcgtcaagatatgaatcacagacacaccaaattgttaagttatgtttaccagatgtcggagtgtcaaattccaattcatattgctgagtctctttatttaaagtaactttcttgatcgcataaagctcttttttagatacttcacctaaaaccaaccaccaactttctagcttatcaaacggatacttttcagatgttacttgtaagttctcaggttcaacatctcttgtcaattgaatggtaattttctgttttacacctgaaattaacgaatcagaattattcaacgaataagtaagttcaacgttggggt

SEQ ID NO: 14081 - DNA, 493 bp, Saccharomyces cerevisiae
tgatatactcaagcagactatgattttatgtttaatctttatgtaacgcttcatttaataattttatttctaatatttgatatattttctttttttgataactccgaatgatgaggggagacgttagtattacttctcttgtcttatgttattatcataatcgatgactttaactgtgcacactataatatacagcatctccagagcatgatagcaagaaattttctttaagaaagcctctatataccctatatatgctgttaacaggaaaagagcacaaggtttattttgctttggttgcaaattttcatcgcttatagaagacatattttgatgtaaaaaccttgatatacttcctttttgccttatctttcactgtttccatctcttttcttttttttttttttttttttttttttttttttttttttttttgaatcttaaaattctcgaaactgcactgaaatggcgcaggaaactgacctcatcgcat

SEQ ID NO: 14082 - DNA, 423 bp, Saccharomyces cerevisiae
gaaaaatgaaactgtgcttgataatatatatatatgcatatgtaagacatggtgaaggggaaagtgtaatgcataatagttcaaataagagcaactttgtcgtctctcagcagatccctaatgacttcatatctcataacgtaaatacttccaatagtgagttcaacctcttcctttaaatcgggtattgtgaccgtgtagcaaggtttaccgaactcgttttcctgcaatagcggatcttcgttccatttaccatctggtgggccgttaacgtgtataaagacaaatttgttccagtcgggctcatctatcatgtttacgctaccttctgtatcattaatagcctgaagttcttcgggcatgtatttcaggatagaatcattgactagtttcaaccagatcagggaatgcgtgtcatggtat

SEQ ID NO: 14083 - DNA, 500 bp, Saccharomyces cerevisiae
gaacagttatagcgataaagatttgcaaaaaaaaagtgtagatgcatactttttaaatggcattgaatatacatataatttgttttgtaactgaattatcaaggagctctatccaaacataatagagttagtaagtgtatacatgtttctctttgggttttaattctaaaggcaattacatcgttccgatgaatgagaaggccgcattaaaatacctaatgacctcttaatgaaagttgcatatatacatttaaattaaattgtcatttcaattccgatttattgaaacaggacgtccgaaagcagaaacagatttatgtgcttaataacccaataaaggacttcaatgtattcacgaaacaacacccttttaataactagaataaataatgttacaatacctacactacttcatacttgattcaagaataattttttttaattctttccctagatcaataagtttcaattcatttttatttttccaagaacaaacgtgt

SEQ ID NO: 14084 - DNA, 489 bp, Saccharomyces cerevisiae
ctttacgccatcgcatatcagccccactataaataaagagcaagtgttcatggaagtggcacgtttgtgcttcggcggtaagtacatgcagtatatatgtttaacttttttgaatatagaatattaattaacacggaataggctattttgagacaggcatgctttttcaaaacatatcaagccatttaaaatatttgaaccaagtaggctcaacgagaatacaattggccttggcaaatttttttgccatctcctgcttatggttgaaaccccaaatatgtggtaagttccaacttctagttccatttcgagaagaaacttccaacggaaactgttccaagtgtccctcaatgatacactttctgcctttaatctctttgacgtttgcttttagtataatcgtagtatctacaggaatgtcctcaaaaaactctagcgacagccttgcagttacacctcttttactaggcaacaaagggaagccacaat

SEQ ID NO: 14085 - DNA, 500 bp, Saccharomyces cerevisiae
tgagccaatcaagccaaaaataaataatgtacatagatgtattcaatttaagaaataggaagagaatggaataaggcaggcatgaaatttcatttgccttctgccgcattcttacccaatctataactgccaatcgcactaccccagttaattttggatctcgtgactggtaatcttcttcttaaggccttaaactgtttttcgttcaagtcgaaaaatgaaagatctagatcattttcgaaattcgtctcaatatcccttattgtgcaaacaacgtcatcaacgttagattgattgatatccttcccagattggaaactaacgttaccgtcttcgtaatagtggacttgcgtagagatttgaccggataactccctggtctccaaatcgtagatgtagcttgatctccaatggccgttccagaaattgtttggattatatttggtgctaacaataataatagaaattttacttatttcctcagggactgggtaaacagc

SEQ ID NO: 14086 - DNA, 500 bp, Saccharomyces cerevisiae
gctacgtgactactacttttccttttttttttcttttttcgaacacatctcaccccctatacctcacacaatcactatggtccccttttctttttaccgatatttatactgtccacctttttcttttcgttaatggcctcaatgtttctgtaccattatccaagtgaacttgttagacgaccaaatatagccaagattcattacgattatctttaactagcaagtagtattcttggatagagagattttcaaagacggaacaattttaaatagatttacataagaaaacacatactgtccgatacccataagaaatttaagaactcttttcatcttcagctttccggcctccttttactgtagcctgttcctagacagctaaaaatagtacatatgcagctctgcaatagtctcaaaggggatattgtgtaggtttacgaaatcatcacatttccgaatcaggacatgaaggcacaactttccgcacgtagtgttttcag

SEQ ID NO: 14087 - DNA, 403 bp, Saccharomyces cerevisiae
atgtagaagcaagagtacaattcaggaactcatattaacacagtgatcgatctgaattctaaaaataaacttaatgacgatttttctacctagttacataaacctttgtatcactataacgcaattctgtcatgtgtgacggagtgacctcgttatacatatccctgcattaaaagcatgcggtaaaaactgaaatttaaaaatgaaaaaaaaaaaaattagatattcggaagacttgtaattaagcattatctcgaataaagaaaggttacactgaaagtttcatactcgcggtcactcttaataatagctatattttctgattttctcttaagattttgaaaagggcatctgaacgactgcccactcagccatattcaacaaatcgtcgagcgcataccta

SEQ ID NO: 14088 - DNA, 447 bp, Saccharomyces cerevisiae
gtagacgaggaaaataaaattgtttcgtatattccgtgtttggggtataagtagattgttttcatatatacgcatttggtcttagttcagtaggttgattacttagttccttgtaccttcttctgcaaatatcattcattgttacttcgaagaagaaaaaaaataatcatggaaaattggaaaaaaaaaaagtccaatctaaaaaataaaaatgttcaagtcatcgattctatggggaggaaaaggacaatcagaaccgaagtgttgtgtagctaaaatatgtcattttccttcggctttacttccaatgactttgatgatgatgagcttgttgctcaacctgaaacattcgttgaaagcagcaaagaaaacgaaaataccactgcttacatcaatccattagattcggatttcttgtcgcaagctggagttgtgcagccaaatgtg

SEQ ID NO: 14089 - DNA, 431 bp, Saccharomyces cerevisiae
ccattttctcatcaagcctacatatatacttaattaataacggaatactacgcttttccatcgtaagtaataatgacattcatacttgacattttaataccagataattttaatgcccacctacaaacatctagcctcaatattcttcacctgaaaccagctgaatagtaatataccaatattctttcaacgattgatataattatcatcatgaacggaaaagatgacgcgattttccagtatttttttcttcctttcgttctaacgtttgcggtaagcaaaggagagtagtaattagcaaacagttataaatagaaagcctctctaagattatagatatatagtcatactaaagcttgagatctcatctttttcgagaacctaccggcatattaaactgaagtaagacatcattctgaggaaaggatcgg

SEQ ID NO: 14090 - DNA, 425 bp, Saccharomyces cerevisiae
taatgattatatgtaaaatttgccgtttacattctataaagtgatatcagactctaatatattcgccaattcatgtttctggcaggccacttgtagagcttggagttgcctggtgacacctaattccaaaaatatctggaacataccttgtaaagcgacattttgatcagtcataaattttgattttgttgcggcgtattcacgtttcacaagaaccaacaaccttttcagtattatgttggatagattcttctggtcagcattttctctcattgtgtggtaacaagatattgccaagaacgggaagaatttgatcacgcttactctcaatgtcgtacaatctaataaatgtaggttatagaacttggcgaaaacaccctgaaaattaaaatttggatgtagaacaaccaacccagattccatga

SEQ ID NO: 14091 - DNA, 403 bp, Saccharomyces cerevisiae
catttgtttttgaatatatgtataggaattctttttattaataatgatattaaattatacaaaaaatagcggaaggagatgtcttgtttatctcgagtgtatttatctgtatatttttgtgcgtaaaacgaagtaaaaagggagaaaaattaatgtagcactgattgaaatccaacgcagtactttgtagttgtagttttgttttgttttgcagaaacacaaagcgacgtataataaaaactgaagttcgctatccaaatgtaaccactttagttcttaggagacatggtggagtcaacagcatggtaaatgacaattaaagtcatcatcacaataccgaaggtgatggccaaggagttcagctgttcatcagagatcatcttttgcttgctctgtactgggt

SEQ ID NO: 14092 - DNA, 467 bp, Saccharomyces cerevisiae
acaaattgtatggtggcaggtacctagatgtaattaggtatgtaagcacttataacacgacggaaatacccggatattgtatttttatttttttcccattagcacgccaaacataagaaaaaacgcatacaaagacgtaaaggaatagttcataggtgtaaatacaaaatatatatcacatttaagcatagcaaattgcaaaagccgaacaaaatgcgtatagcgatgcatctgccgctgttgcttttatacatattcttactacccctttcaggtgcaaataacacagatgctgcacacgaagttatagcaacgaacacaaataattgggccgtattagtatccacgtcgcggttctggttcaattacaggcacatggctaatgtccttagtatgtataggactgtaaagaggttaggtataccggattcacaaataatattgatgctgagtgatgatgtggcctg

SEQ ID NO: 14093 - DNA, 467 bp, Saccharomyces cerevisiae
ataattaatcgtaggataggttacatgatcattgcaatagatgtacatcttgtattacgtatgcgtaagttgtctttttttcagttttctaataaatttcacgtgatgcggtagttttttttgggggtgcaaagttggcacatcttgtagtgcatttttgagcttcttaaatgacttgaatcatcttaaaacattgcaggatgagatttccaacgacacaagagagaactagcgcaaaagatggcagagataaaacattatcaattcaatgtcgtcatgacctgctcgggatgttctggtgcagtcaataaagttttgacgaaattagaaccagacgtttccaaaatagatatatcccttgaaaagcaattagtagatgtatatactacacttccttacgattttattttagaaaagattaagaaaaccggaaaggaagttagatctggcaaacaattgtgaatgaa

SEQ ID NO: 14094 - DNA, 400 bp, Saccharomyces cerevisiae
cgaattcgcatttctttattatgccataaatcaaatattattcaggacattagtaaaatattgtaacattctcctcaaaaatgagaggagaataaaaataacaaaagcgaagaaatgcgacgtcatttactcattattttaaactaaataaaaaaaatattgtaactacttatcgttgtaatgatatcttttcttcaaaaaaatatatagttggtgataaatatgacctctttgaaaaaaagaaaaggaaatgaactactagctagaaagaagagagaaaaaaaaaaaaactagattatgcgtgttgcaatttttgctttaggccgtgcgtggttttgtgtaaggtttcattattcttgatgggaatcgattggctttcggcgggtttagtggtgtgtct

SEQ ID NO: 14095 - DNA, 500 bp, Saccharomyces cerevisiae
tatactactatttaagctctttgtatgtaaagtgagcaaatctcaaattttgctacttaattcttattttcgtgctagccctacaacggaacccaaaaaatcaatcaccagggtaagcgggaaaaaaaaaaagtgtaggaaccgcactataaaaagtcgaaggtttgtattaattttccacacctctttagttttgttataatcaaattccttttggtttttgttttaaaaaggccaacatcataattatatcgcgaatgtactactagtatatgcagttttcttaaaattgcagggaatgactaaaagcccacgtttttcccacttttagtagtactgaagcgtagatagattgaacgttgctgggcgcctggtgttgatcatttctgaaatgagatattgggaatcagctgtatctacattttatttatacatatttatttttactggttcttagtaacgtactttagtagcaatgctgtgttttagtgcgaacgcct

SEQ ID NO: 14096 - DNA, 466 bp, Saccharomyces cerevisiae
ttctagatatattgagaggtgaagtttaccttgtttatggtatatggtacaaaaagaactaaactaattatacgtctatatatatatatatatatataacagctttattaaaccttgttttttaatatagaagaaaatgctttatgatcggtattattgtgtttgcatttacttatgtttgcaagaaatttactcggcaattttaacaattttaccaattgctattgtggtaccttgatctctcaaagtgaatctacctaattgagggtaatcttggtaagtttccacacaaactggagcttcagtttctaaaacagcgatgaccttcatacccttcttagcaaaagcaggtggtttctttgacttacggttggtacccttttctaatttgtgcaataacttaacaatatgtacctcttcaattgctgtatgaacatgcataacacatgaaaaaccggctgctatg

SEQ ID NO: 14097 - DNA, 422 bp, Saccharomyces cerevisiae
ttatcactaaaagtgaggaagaatgccctagttttgatagataatgaaaacaaaattaaaaaacaataaatcactttatacaattatctaatggtagatttaaaagtcatgtttgatttgatatttttttattgaaatttaaaattaaatgaaggttattattttgtaaatctttatttaatttaagcttccaaagccaaacgaccctttgggttggtgaccttgatacccaaagccttagctctagccaaaatgacaactctgttcttagcggagatgttgtgagcaatttcagcggcgtaagtcttggtgtgcatggtcaaggtttccaaatccttaacgttagcgactaagaaagtcttgtgaccagatggtgacaaaaacttggtcttcttgttagaaccgtaaccgatctttggttg

SEQ ID NO: 14098 - DNA, 470 bp, Saccharomyces cerevisiae
tctatatacgtaatatttttcagaatctcttaaaatgcatgtcaaatctcggaatttatcatgacccattacataacaagagaaaagtggtttgcattgtatgtataccttaaaccaattcttcggtagtcacatgacctatatatagggacattcatttcttgaataggatatttcttaaacttaagggaaattttgatgaaaatttagaatctctcgacaacagtgcagagcagtaagttttattcaatacgaaatgtgtgcagggttttacccattcatgtcgagtacgtctacatttgttctgcgatttaacttaatacttagcctactcatatgtatcgaagccaaactattaaatctgaaaactgaatacccattaagtaggtacattaatgcaattttcgtccgaaaggtagagtgttaatcatgcttttacttcgaaatctagagtccgagcatgtctgatg

SEQ ID NO: 14099 - DNA, 439 bp, Saccharomyces cerevisiae
tctcttttttcgccttcatgttttatatattatataaatttgtttacttatttttactatttgtaataatgattctgctttacgcgcctttaaaaaagttggtcttaatgtaaacatgaaccatagcacacaatttaagacatcagctgtcaaatgaccataaaattgtcctaccagctgtccttaaagtttagtgtacacttacgaatgacttatttactcacctttgcaactttgttcaataaattcattgatcttttcaagttcctgacatcttttgtaactggcatagagcttcagacttgaccagcctatagcagcagtaccacaacctataatattgaaaatcattctaaattccgaaggggagcaattcggcgtccattcaattttaaactttctctgtatccatagaaaagcattcaatagaagacctcct

SEQ ID NO: 14100 - DNA, 424 bp, Saccharomyces cerevisiae
gtagatatcaaagaattacgtcatcaaccaagacaaccgcactattcgtaaaaatgattttaaatacaaagacagaataacaggggaagatggaggtatataataatgcgaatgcttcataatactatgactggttttccattgggcatatgagatgattttacggctcaatcactacttatatatgatttctataacaaagcaggccattacacattaggaacggctatctattacataagaatatgcagcaaattcgttggatatgttaaagtatattccacgcatgctgagaagtggattgccagaaacgtgacgtgaaatacctactagaacaaaaaaaaaaggaatgcaaacgttctaggagccataggaatcaaaaagaaaaaaattgaattaatagagttcgtgagaatcattgcga

SEQ ID NO: 14101 - DNA, 423 bp, Saccharomyces cerevisiae
gttcaaagaggagaacgtttgaaaaagagttcggtggccctccacttttttcaacgtgcaaaagttgtccacaacttacttatcattaggctaaaattacaatttatatcttacgtatcctttatctaatttgcgactgtaaacataaatttaggataatattaggagagacagagggaaccgcaactttacttcgttttcgattgagataaagtaggttgctcgtcgatgggcgcttcgtctgataaactttccaacccatcataaagtgttttccacaaatcagaaactgactggaattctcttcccacagctatcgagctctccaatgatatattgagaccattcagaccattcaagattgaattcatagtctcattgatctcctgcaatactatattcctctgctcgatgaagtatttg

SEQ ID NO: 14102 - DNA, 442 bp, Saccharomyces cerevisiae
ttctaatagataatagtaatcggttttataatatgataaactcctatccgctgacataattgttggtcacaaaattcttttatctttcttcatcattgaccttttatgattcctttggtatgcaaaaaaaaaaaaattgtgttgaagaataaaaacaaattacagaataagtcacacatgatataaaaagaagcccagtttttcatagctattaagggggcataaatgcacttatatgagggaaggtgattctaattcaaaaaaatctgcggatgttgctgtcctctccatcatccttacgggttcgaccttaacattgatctacacatataaaaggtatttaactcaattcaaaagaacaaatgatataccgcgaagaatatttcgtaaacactggctttatggtaaagtcacgtctgtaggtgacggggacaactttcat

SEQ ID NO: 14103 - DNA, 415 bp, Saccharomyces cerevisiae
tgagtaatatctgataaggaacgcttttatttagctttttaactacatagacgaatataatatacgatcgggatacattagcatattcagctcttttacctctcaatttgctcaagattagtatcgtgaccaattttagatcatttcggtcagaacagccacattttcgcgtaatttaaaagttcaattattgtatgcgtgacacactatattagcgtcaactgttaataaggaagtagtggataataacggttcaggttgcttcacaatgcttatttcaaaatctaagatgtttaaaacattttggatactaaccagcatagttctcctggcatctgccaccgttgatattagtaaactacaagaattcgaagaatatcaaaagttcacgaatgaatctttactgtgggcaccg

SEQ ID NO: 14104 - DNA, 448 bp, Saccharomyces cerevisiae
ggattcttataagggcgcataaaaaataaataactaccattcataacagaaattcattcgtatatacataaagttctcataaacgtatatatatatatatatatatacttattgatatcaaagtgtgttactttctacattcatagacggggaagaaaagtgaggaaaagttgttttctcttgtgcactgcagccctttgaaaaagtagaactgcagaaaaaataactgaacgtaaagcattatttacttttcaaaggcaaaagagatagagccaaaaaaattgtaagcagcttaaaagccataatgacaacggaagatccagattcaaatcacttaagttccgaaactggcattaaattggcattggacccgaacttaattacattggcactaagttctaatccaaactctagccttcattcaccaacgtctgatgaacccgtacct

SEQ ID NO: 14105 - DNA, 477 bp, Saccharomyces cerevisiae
agggacttttgctaaatcgcagtttctttatccttgcaaaactggctttcaacaaatccggtatatatataattatcatattagttgaaaaaaaaaagctacaataaaattaagaaataagaaatgcacctaactgctgtatttggagtacatattttcatcaaaaacagagggtctattgtaaaaggacgtaggattctcttgcagttcacgttcttcgttttcaactgctttacgtcttctcaagtcgtacatatcctcttgcgattgtttcggtggtactggtggggctgccatagtaggcgttgcagcatatggcgaagcttcataagttcttggtggaataccgggtccttgaggtaaatcactgccggcacttattttgagattttgaaattggtcccctaaattgagcccttgtctagataatgactgaaaggctgcacttttttggggcagtaatggaggacccccaac

SEQ ID NO: 14106 - DNA, 444 bp, Saccharomyces cerevisiae
cgctacctccagcagatttgattaggtgatgagacaaatagtttcttcgagggcagtcacgaaatgtttacaagcgaaaagaaagaaattatgaaccatatgcacttctgttcaatgcgatgtgaatatgaatatgaatataaatatgaatataaataaataaataaataaatgcgttgcacgtttcttttcatttatttgtgcgtgcttttacctgtttataactgtagtcaccaaagctatgctatactctagacctaactttttcgttttgtatttatttagccgctcgctggagttttttttttttcggtgataagatgatttatatcaaaccgaaacaagcgaaaagtttctgttcatcgactataaaatggaagagaaaattggtccatagacttttcatgtgtacttgtttatgagaagagacgcaggaagaccaga

SEQ ID NO: 14107 - DNA, 469 bp, Saccharomyces cerevisiae
aatgcaaatagctagagtagccatgaggataatgtaaatttaaacattgtatgcccacgtaatagtcaaactctttcacgtcaaattgaaaaaaaatgttctttttgctgaaataatgaaaaataatgaaaaataatgttgctattaaattcaatataaatgtatacaccaatatatatgcaggtataattcctaacacttttacttcaagatcatgatctaggctttcttttttttgggataaatgggctagatgaagcattccgtctcgaactgttgcgtgtgcctgtgggcccactaccaggtcctttgaatgctgaagattgtggttgcggatgggggtttaaatcatatggatcttctgcctcagcaggatagctgtcttgcggatgggcgggcagagtttcatgcagttcgcctgtacccacaggagccgttgagtattgattcgcattacccacatgttgag

SEQ ID NO: 14108 - DNA, 420 bp, Saccharomyces cerevisiae
aaaatctattgcagtacttagtttggcaaaaaatataaataaacacaatcaggtactcttatgtatttatgtgagccatttataaagaattataaaggatatgaaaacatatattagtttgtttttttgaatgtttcaagtttcttgccaacagaggaagtcgtaacgaaagaaacaacaaaaaatatccacgcaacaatgacgccacaaatggcgctaatataaacccaagaattgctgatttcccaacttcttgggtattcatcattagcaaggtgacggatagctttaacgtctttgtcagtagtgaacgacaggccaatcttacgatagtcagtgaggaatgtaaacactccatggcggtctggaaggatgaattcaccggtggtgtaatactgagtttcagaatcgtttccgctt

SEQ ID NO: 14109 - DNA, 424 bp, Saccharomyces cerevisiae
acgataaaagtttttcatgtgtacagtctatataaaatatgcatatcatgtggttacataagaagaatgttaatcttgtttggagattttgtttttggaaacttcgccattgcgaagggtgttgcaaactgaatttctgtttaagtttttaattaataatccttattttgatcttttctgatggccgtgtttgaacgcatagtattgtgaatataagcgaagtgaaaacctttacacctgcggcagatgccatattactgcgctagtggtgaatattattaagcgtgctatcaaaaagagatgaaaacgtgctaactaaaaaggactcagattcgttacacacttagcctcgaataacgatcaggatctgttctaaccacaactccatggacagcatgcaatgtttgggctcttgataacgtcc

SEQ ID NO: 14110 - DNA, 491 bp, Saccharomyces cerevisiae
aagctgaagcatggacgaatatttttaaaaatcacgtaggataaatagtaatattaaacgacattggattgattattgtatcgttgcaggtctttttttatttactttaaaaaaaaaacttttaaggtgaacgtatttatatattatgccattggtatgcatagctaaaagaaaagaaatacataagattgtagtatgtatgatatgcttatagaaatagttgtgtgcttcattccttccactccaacagtgatgtcaaatcctttggatcacatgccatattgaaaaaaccgtggtgtaaaagctcttcggttgatgccctatatctaacatctacgcaaaggcaaacgcttagaaagcgtttaatttctaaagacaaactttctggatgcttgagctttggtgtaccattagttgcaattaagtacaacgcctttagtggatcttcatttaaatatggtggttcaccctccagcatttcaatggtcatg

SEQ ID NO: 14111 - DNA, 434 bp, Saccharomyces cerevisiae
tagtattgctttaagcctctaaactgcatatatagttggttgcctaacattatcatgatatgaagaattttctcatactttgaaacataggacaagtaaaactttataagatcatgtgcactttgtgtatgttatttcataattttcattaaattcttataacggcttatgtagaaataattatcatttttataatagaagattgaatatagaggtaatgtataaagggcacataatgaagcactagtggttcatttaagaaagaataaagagggaacaatccaaatagacaaaaattccgattaatcaaggtccatgttttcatcattgttgtcatcgctatcatcacttgcagcgcgtgcccttctttgctcagccaatttttcagcaatatcattcattttagaagtttcttgattcgctctgagtgcttg

SEQ ID NO: 14112 - DNA, 499 bp, Saccharomyces cerevisiae
acttttttttgagcgaactttttttgtatatagtttagttaccatttccgtactttggatgtaaattaaaattaaagagagacattatttttagttgcgaatacataacagcgaatgttcatggggaaaagttaaaaaccctatataaagcaccacgaaatacacatcgcgaacagagctaatgagagtatacacttgctaactatatgaaacacaatcgtccaaatggtactgggaaagcagtttctggcttcaagcagataataagaaggcttctactcctcttgaacaagaagagaagaaaacaactcgtcatcatcttgaaaagaataacccaagtctatggaataaacctagtattttatgtcaaaaaatggaaattgaaaaaattacagggtgaaaatattcaaataaatgatatcatgccatggctaagagagtctactatattagtcttgctgaacatactatatccaactttgatgaagttcccattttt

SEQ ID NO: 14113 - DNA, 422 bp, Saccharomyces cerevisiae
cttgaacagttgtactaaggcagtttaagtccattatactgtgcgcatgcaccggcatagctgccgccgcctattcatccatgactgtttatatttctgtagctagctctcttttcatgaagcgccatatatattattttttgaaagctgaaagatagaaactataaataaaataaagccgagagagagaaagacccaaataacctttaatattatagcctttaataacaatggaattacaacaattatctaattattcacctgcatcccaaaaatattagtcgtagccaagatgaaccaatcgatgtgtgttatatgtacctctgctttgcagtataagaaatttacatttatttctgactaataacaccttggtgccccaacggtaaacaacttgtatcagttctcataagtgcggccat

SEQ ID NO: 14114 - DNA, 428 bp, Saccharomyces cerevisiae
aaataaacacaaggctttcatgtgtatacttaataataattaagtgagctgctgctttgaataagttgaaggacaactggtgttatctcgcttgtctatccaaaccttcaagaatagggtaaatgcaaaagcaaatataaaatgccacaactacaatcaaaaaaagaaatgtcatcgcttgttacaatattttcattcctttattcaaggatttttttttttaatttttcgttaaaaaatattgatcactttatagggaatattatgtacctggctacagctgaagcttgcctctgtatgtaaagtatctaaaatatatcaatttttttttttggataacacctgttttcattaccctgtatctcgtattcgtgaaaataactattctgaagtaataattataaaaaacatttcggaaaacaaaacca

SEQ ID NO: 14115 - DNA, 486 bp, Saccharomyces cerevisiae
ggtaaatgaaattaatcataaatcataaattatatttaaaataataatttactcggccggaccccgaaggagtacccaaatatttacttgtttataatttattattgaaaatgttttattctatattggtagagttaataaataattatataataaattattgtatgataatataaataatagtttatgtaatattttaagttattatttataataaaaaagtaactattgaacctgttaaattaaaatatattcaaaaaacattagaggttggtaagattctattaaatcgcagaaatcaaataatatgaagagtaaaacaggtagatgaaataaatttattattaatttagtttacgtaaatcgaaatgacaggccttttctgtgttttttgatggttatataatcagaaaaatttgataaatattgtttatatgtaaagactattaatgattgtttctatcgtcaggatattttgaaaacgtc

SEQ ID NO: 14116 - DNA, 402 bp, Saccharomyces cerevisiae
gcttatatccttttcaacattgccggtatgattgtggtttattacgttgttcaagttaagcatttttcccctatgaaaattggcttcgtaaaaagaataacaagtaaatttaagagaaaatgaagaaaaaaattgcaggtatactatgggtgcaggtgaggcggttttttaaccgatttagcacacgatactgtgaattttgggttatatgatgatgtgaatattgcagaaatgtaatgttatattattcaaagaaatagggtaacttctatttatgcaaacattggtaatcaaggctataaacacataatcccaaataagtattttggtacacagttgatgtttctttatgaatacgactcattagttcactgtcaaattgccaacgttcagagggaccta

SEQ ID NO: 14117 - DNA, 422 bp, Saccharomyces cerevisiae
gtagttacgaaacgtttggcgggatgctttctttttattattgcataaaatttagtgtatactctatatataatccatatggaggggacagttgttattaccgctctctataagactcgagaatgaactgcgtctggttatgccatcgattcctttatccatatcactaagtaataatactggcatatcattttcattttcattttcattagtaccttcctcctcagaatgaagtgaaaatctaatattaggaatcagagctggctgtactgaagaagcgacagtttctaagttttctatattgctatgttcaccctcagtgagaaggtttctgtcattcaccatatttgcggtagcattttcattatcaaatggagaatcaatatgaatagtagttgtagattcagcatccgacagtgatc

SEQ ID NO: 14118 - DNA, 497 bp, Saccharomyces cerevisiae
tgggcttttagggacagttctattcttccaacgtgcgaagcgttccaatgaaactctgctgcgcgctgaaaactatataaaaaaaaaaaaagataaaattacaaagaagtaatgaacttaaatgctattatacagttactaattaagctgcgtagtgtgaaatatattgatagttgtagttttgaggttttattaccctctgttatataataggttttcgctattttattgccgaaaatcaagacggagcgtaagcctcttcgggcaataccttcgactattccaacaataaaatttaaaaaaagagattaatcacatagtaacaagaaataaacgaaaaacatatcataggagatcaatgagccaacttcacataaactaacagtgaaaagtctataacaatattaattttacacaattaaatctacactataactggcactgttaataatcggtaatctgctaagtaacttttttttctcattcacaaagcatcg

SEQ ID NO: 14119 - DNA, 450 bp, Saccharomyces cerevisiae
tgagggggaaattttgcatatatttacgcttccccatcgttttcttaaacattgttacttatctgcttatttttatttaagatatctatctacctgtttataactctctcaataccatgtatttaagttcatcacgacgaggcttatttacttaatatatttgtatacgtgggaaatgtctaatatgtataccggtttgcatcttattttgggtggggtcactaacggcaagactcataaaataaagtattcgctaagcactctgttatatttgtaaactttgagaaaggaaatgggaaccaaagcatataatagacaatatgttaaaaagacgctctaatgctctcattactttgagtagaactaaattgtttcccataacaaccgttgcctattaccacaggcgcctcctcaaccaacaacgaagagctgtttcaacgtcaccgaaga

SEQ ID NO: 14120 - DNA, 477 bp, Saccharomyces cerevisiae
gaatatgttatctttgaagtgtggttgttgttccgtttgtatccctttaaatgaacgaagagaaacaagggggctaacctggccaggttgttttatgtgattttatttagataaatatttatataaatattcagtgagagaaaaggagtgcgttaataaggcgcgccgggtttaaagctgaaaaataggacacattaatatatatacgttaaatattggtgaatacttatgggcaaggtggaagagaatctctactatccataaatcctcagtaggctttcccctaattaccttcatttttctacctcaataacatattactccttttcaatacattttatggtggtgaacacgatatatatcgcaaggcatggatacagatccaactggcttccggagggtccatatcctgacccacttacaggaattgatagcgatgttcctttagcagaacacggagtccagcaagccaaagag

SEQ ID NO: 14121 - DNA, 492 bp, Saccharomyces cerevisiae
gaacagaacacaaaaggaacactttacaaatgtaactaactaaactattcttcaattcattgtcattatatctttctctctattcttttttatctacttatttgttatgttatgatccaggtacgctttaaaacaaacagttactttcctcaccattcatcccttcccctccttttcctgtgtttctgaatattgcggttcattattctttgatatgaatttatttgtgtattgtataagcttactttccttttatatgtatatgtatatatatatatatatatactatcttttttcttatatttaaaactaaaaaaaaaaaaactacatgtgctcatgaatataaaatttatagatctttgattcccttctctaaagcagtagggttagctccaatgatcttgccgatgagttggccatccttgccaagaacaaaggtgggcatagccgtcacttcacactctttggcaatatctggtgattcgtccacgt

SEQ ID NO: 14122 - DNA, 449 bp, Saccharomyces cerevisiae
gcataaatatacaaaaacagaaacgggaaaagacttcaacttaatatataaatgcacgtatatctatacccgtagtatatatcatttgtacctcaatacaatttcaaatcacctgttatttgatccaatactgcttttggagcaggtcctaaacccaatacggtggcacttcccgcagcaatctgtgttctaccagcatcatgaataactgctgcattcaccccaagtgatatagccttcgcatacaactcgtccattgtaaacttatctggacatttcaacgttattttagcctgtccagcatttagccatctttgtgtcataattgggttgtatgaagcacgcgcggggtttgtagcaatatgtctaaaacatgacaatgctgcgtgacagcattgtgccgctattttgccctttgtcatgccaagatcttgacgaatcaccaatgc

SEQ ID NO: 14123 - DNA, 476 bp, Saccharomyces cerevisiae
gcatgaaaaaggtattcatattgtgttatttacattaagcggagttaatgtctatctttaatctgctatcttcatctttttttcatattagatattcgttatcatactgcctaattttttagtgtttttatatatctatatcatatcacctttattaatatctgtcttatatatcaggagagatggctcagaatacgcatgttttcagcatacacaagtacttatcgtgataactgataaatttctcattttctgtcttggttatttcgccgttttccaaagctaaatcattcaataattttctttcatgcagaagtaccgcaaacgaatgtctctttaaaatggatatcttattagttttactaggagtttcttctgcttttatcattggtacattgtttgttctattattgccgtcgttatcctcattctcttcttcttcttcgtaagcttgagtgcttgtatcattctcgcca

SEQ ID NO: 14124 - DNA, 410 bp, Saccharomyces cerevisiae
aggcatatgtagtgaagtgaacatacacatagctattcgtactaaatgatatgaaatttttataaatgccaggctatatagctatttaaagtgaccatggcagaaggatgaaccgaggtaatacggctagtacaaaagcaacaaagttaggaatacaatttgagaaacgaagaccatagaaaatacttgtgcgattgaacttccttccaaaaaaaaaatagcgtcaaagaaagatgagtggactaccgcccccacctcctggttttgaagaggacagcgacttagcacttccaccaccaccaccaccaccgcctggatacgaaatcgaagaactggataatccgatggtgccatcatcggtaaatgaggatacattccttccgcctccaccacctcctccaagcaacttc

SEQ ID NO: 14125 - DNA, 432 bp, Saccharomyces cerevisiae
acacaaatttaactacttcccgtctataaacgtacataaactagaataaaaagaaccatacagatgttcatcgtaagagtggataaagcgaatatgagagccatattggttattccagaggctatctattttttaagagaaactgcttggttaaaatttgcataatattgtctcggagagaaaagatagaactcagaaggacctaattaatcatgagcgttataatacgaagaattgagatagagtgtatgatctgcggattaagctcctacataataacaacattgtacttgggactatgccaatttctttcccaccaaaagtcgtatgaaaaaggttatcttcgctagggcttccattaggtgaaagccaatatattatcatagaatagcacggcataaatatatattttgtgctgtctttttgggaagg

SEQ ID NO: 14126 - DNA, 410 bp, Saccharomyces cerevisiae
gaaggatccgttataaaccgcgcaaaaattatgcatagacatagagatatgcaatgtgtatgtgtgtatgtatgtatatgtataaacgtaccaaatctattttgcatgcatctctcacatgacgaatgaggttttagtagaataggattccagatttttaaactggagaacatattctatcatatatataccaattaaattcacgtagcgaatgcacaacacggtttacaagtcaatagttaacaataggaagaccaagctatatattgaagccgctgaggtctaattcgccattatctccagtggtcgaccagtcaatattaaggtcgttgaaatcatttaatgtcaagtattcttcaccgttgtcggctggaggagggttatctccaggattggaaacaacggtcgtt

SEQ ID NO: 14127 - DNA, 458 bp, Saccharomyces cerevisiae
agagctcatttattctcaatgtgagtcatgtttataaaagttaatgttttcgaactcttattgcacacacacacacacacgtatacatagtttttaagtccacttcgatccatctttattttttttttctttcatgtaagcaacgggcggactattgtaagaaaattttatattgcctcatcacataaactaatatgcgaacaatatacaattgaattctcaacattgcccattctcaaaattgcccaatcatagaaaggaaaatggctcctaaatctagttcttccggttccaaaaagaaatcatcggcaagttctaatagtgctgatgcaaaagcatccaaatttaaattgcctgctgaatttattaccagaccacatccttctaaagatcatggcaaggaaacatgcacagcatatattcatcctaacgtattatcctcgcttgagataaatccg

SEQ ID NO: 14128 - DNA, 436 bp, Saccharomyces cerevisiae
ctggagtaattctcgtgatcttgtttaattacattattgagaacatttttatatatataccttttattggaaattagtagcgagcttagaagacttacttgatttgttgagtcgaatattatttcggcatccacacattagaaaattaacaagatgtattttgagagaaagcaaggcacaacgcatgggaaatcttcacaaattttaaatactatctataaactaactctaattataaaagtggcttgattactttcggtgtcaaaagaaaaagtaaatgtatggcgtaaatgctatgattagttatcagaaaataaagatgtttataagtattatactgtctgatttaatttcctcgatatattaaaattctaataccattatgtccttctggtaaactgtggaacaaaataaaacatagccaggaagcctgaag

SEQ ID NO: 14129 - DNA, 455 bp, Saccharomyces cerevisiae
cattagcgcctcctgtgagaaggccattgtgggacagtataaagggtatgatttctagataatctaataatgattatgaagtttttgagatttggggtgatacacatctatgaattactaagagatttgagacacagcgacagtcatgccagcaagatttaagattttctttatttagtgtttatatacatatcagatatctgttgagtattttctattttaccaaaaaaaaaagatatgaaatcaagataaaacgtcgtatgaaagacaagggagctcagcagcaatatcataaagtaaagcaacagcgcttggtttatgtacaatgaacgatctgaaaattagttggcagcggagctacgaatacatgtcaatattacgttacgattgtataacaggggaggagaatcgtgcactttgatgggtatatcgaaagatggtgactatgctagagt

SEQ ID NO: 14130 - DNA, 446 bp, Saccharomyces cerevisiae
ggggaaaagaaaagaataataatgtcttacgcaatatgctcggaaatgatattccacgacattagatgctaatttatagtatatagaaaacaaaaaatacatatctgttttttaatgacctttagtttatatgctttcttgcgcggctattagaatacacttgacaggttgtacgcattattaatcggtaaatggagatatattagagatgatcgttttaaaatggaggctgtctgcaaaaaaattgggagctacattagcaaaaagcttcttttcttgttgttctcggtttatatttcaagagggcagtaggaaaaaggatcgaaaagctcggcctgtggccatgtcctctaaaaatcaaatataatttactggccaacgttatcggctctttttgatatctatcatctctttagctattgttatctggcaactgattcaactga

SEQ ID NO: 14131 - DNA, 420 bp, Saccharomyces cerevisiae
cgtttttatggtacgcattctagaacttgaggggaagaagtctacgtttttaagtgttgacaagcaattcgcttgaaagcgccaaaattcattgtttgttctactcgaatttaagtttccattttggttgatgtcttaagtatacagagaaaccgtttattagcgtatatatacagaaaattttattattttatattcaaaaacaagaaaacaaaagagaaaacattaacatgtaattttcataactaatagtcctagaaagtaatactttttacaactgtttctttaaatcctgtatgaaagccctagttgcagatcatcgtgttattccagtgagttttcacttccctaagtccttcctatttatgttttagtccttcttgcacagcaattttacttcgggcactgttgccgtatatt

SEQ ID NO: 14132 - DNA, 459 bp, Saccharomyces cerevisiae
tttccagcggcatatcgtggctttcaccgaacacttccttcgagagagtgcattttactatgtgaaccaatttttcctctttttcggtttgcaagttcacctgaaaaactgcttaacactactagcaattgccctattgtcgtacgaggactttgccaaatgtattcccggctgtttgtagtatatatacgcagatatataatagcgccgtctttttacctctttgagcgaattgccaaatattgactcttttgtcttatttcgctatccccatcttatcaaaaatgggaacaactcgttgaaataagagacaagcaacaagaaagacaaccaacagaaagttccattccgcacaaatacgctggaatcccatagaatattgcttgttcctctatgactacatgctccaattcaatacagaaaatgatactgtagctccagtgtttcccatggagcaag

SEQ ID NO: 14133 - DNA, 406 bp, Saccharomyces cerevisiae
cattgcataggtgtccatgtagtttaggtgcgcatcttttttgtcgaggaaatagtgaagatgaatacgaaataaactatgggcaaatagttacgaaaaaagactggacttaaacgggttactatatatttgtataagttatctccttgttttctttttactcaaccatcatattaatttgcaagcttacttaacaagtcttgtatactagaagaaacccctccggaattctcaacaccttcgtcggtttgggcgccgacgtggccttctatatctaactcataatgtccatcctcactgttgaaagtaccatcttcactcgtcttcgaatcaagatgaacctttttttccggtatgtcattagcgtcatcatgacctatcatatcatgtgttcgtttcataccaa

SEQ ID NO: 14134 - DNA, 500 bp, Saccharomyces cerevisiae
gcgtgagcattatatagaacaagtatattagtaacaaaggcagattgtatatttttctttttcctatgatgttttttgagagggtaaccaagaattatttattgggtttgttgcagtgttcttaaagggtccctcccacatttaataaatgatcgacaataaataaatgttccttacattctcaatgtgtgtgaactggataatcgtaaaaatgccaaacaggtctgaagaacttgaccgattactcgacaaaataatcaactctccgcatagaacagaagcctcgaagactttgcaagaaattgaaaataatcaatcatatattttaaatgtacagttgaagaagttattgcgacttcatgacgactcatttaaaaataagtgtgtttctcctattaactatatgttggaaaagtacactccgtatatggggcataccgaagcattacaaaaggaagcagagcttgtggatagggatctccgaatccttgaaatgacgt

SEQ ID NO: 14135 - DNA, 458 bp, Saccharomyces cerevisiae
cgggttaatgcttaaatttattgtatgatttatatacttctatacatggtattattattattattattattattattattattattattattattattactattattgcaactatattattttgtctttgattcgtacactttttcccatattacatgctcattttcgattttattcttggtgtcctttagcattgggaccttcttttcgtctataggagctagactgtcatcattttctgcatctatgaggccaacaagagcaatctcgctgcctcgaagtaactgtgccttgcagatgaattccttgcttatgcggttgaaaacattggttatgaatagattagtatttttgtcgaagccgtttaggcttgctatgaggcattcgccgtcaactttgattataacaactcttttatttaagtagtctttcaaggtggctgacatggtgcacgatag

SEQ ID NO: 14136 - DNA, 438 bp, Saccharomyces cerevisiae
gtacattattttcattctccgacagaattgctaccattttactttgtgtcctgtgattcaatagtgtacaatatattggacattttatagtatacaaatatacaccatcaatctatacatccatatcacttgtcgtaaagatatccctttttaatagtacagcgattaaaaaaataacatgattaacgttcagttaccaatgagcttatttattaggcttgctttagatttttccaagtcaatttttgttttttctaacgcttgcaacctcatctcaaccttcttcctttgcaagcagatcttcgaaaccatctcgtttattctctcaatgctgttcccactttcatcatcgtctgggaaaagtaccggtaagggcgtgatgattttctcattcgatttgtttatatttcctttgcttaaaagctgggtttcccattc

SEQ ID NO: 14137 - DNA, 424 bp, Saccharomyces cerevisiae
tgaagagggaaacgggatgcctaaggtatatgattttggtttttttttttttttttttttctaaataaatatatacatattcacaacacataaaatctcttgagtgcattcatcgatgtcactttcttctggaaatcagagcctagataccaggcttaaggcccccacgaacagtacgtgagctattggccattgttcctgcccaaaaaacagacatttactggaaaagtttttgagttataattaattatatagttgttttatgatttttatacatataattaaaataaaatcaagcttcaaccatttctctcaatcttctgatggtagatctaacggtggcggcagcagcagtggagacagtgtaagcaccaccagcgacggtcttcttacaacaggaacaagtccaaataccagcagcacc

SEQ ID NO: 14138 - DNA, 462 bp, Saccharomyces cerevisiae
gacatttaatttaacggatgatgatcataaattggcctatttttttgctgtatgtgttacatattatactatatacgttctccaacaatacaagatgatacggggtaatactccttattcttattctagaagacatacaaatatttatgttttacgcatcgctttctttccctttattttgtattcacaagtatatggcatcttaacattgttactcaattcttaaagataatatctagccttcgctatttatttgccccttccatcgattcttgcatccactacggtatttagcaacaatgcttcattatccaagatgactctatttggagagctagccaagatctttgcaatgtccctggctgtatctaatcttttcaattccacgtagtctcttgatttcttgatggcttcaccaatcagttcggcggatttggcttcaccttgtgccctcactaccat

SEQ ID NO: 14139 - DNA, 495 bp, Saccharomyces cerevisiae
ttgaaatattaaaaccgacaatttactttataaatttacgcaacaacttgttaggtaaaatgaacgtcgtcataatttaaatactagacagcgcgtgtatgttactcatatttatactcatatcatgtgaacctataaaccaattcaatacaagatttacagttctcttgttttcttcttccagttttccccttttatttcctgtagaataaacttaaacagtgatcattaatttataattttctgctttgtaaatacggcggtaatggatgaacaaatgaaaacaaggtttgaaacatagacgtaaggattttatactcctttcaaaaccactaattgaccaacgcctttttttgaagattgacttcttccacatagccatgttgaaatatcgtacattgtctcgatcatgtcatatttttcacccaaaatctctttcaaacaataccctgaaatctgaaactactcaggaactacttcaaactgtgggattcg

SEQ ID NO: 14140 - DNA, 404 bp, Saccharomyces cerevisiae
atgatcgtgattatacaccgttatttaatgggaaaagacttatatagaaagaatatacgtagttttaatttatcaagtgaaaagggcactcgctagaattagcaaaacgccagtgcagcaccatttcaagcaagttgtgcctgagctatgggactgtttcatttcttcatcaccttctccttgatgatgatgatgtccatcgctaaatccgataccagtttggaacatttgtaaaccaattactaataggaaccctgcagtaacgctcagtaaaaaatccatgttgggttcgtgatcccttggagtactacctttaaagatgaaataacctatcaatgcacctaatggttgagatccaccaccgagaacggcagtaatcaaaatggcaacccatttagattcga

SEQ ID NO: 14141 - DNA, 474 bp, Saccharomyces cerevisiae
gaatatgaatgaatagacacatcgatttttacaaaatatacaaaaagttatacgtagaaataatgaattatgcaaaaataggtgtcaataatttaagaatgttccttcatttttattaatatagtaaaaattgttcggcagaaaccaaaatcttcgttctgattttggcgttctagcggcgctaccatcctagtcacatacctcaagtattcaccataatttcgttgataacttatccggcagaaactttctcatctttcagaaacctaacactgcagttggacattctcgtaacattagctgacagaactacgacagacagttgcgacataaaaaaaaaagaatcacaactgaacgcatcttagggaaacagttaatgttggcactgatgattatttgaatagtgcgtctttatatatatatattttcttcaaggtattcctccatctgaaaataattgagcattcgacccaa

SEQ ID NO: 14142 - DNA, 404 bp, Saccharomyces cerevisiae
tactaaagggccccgttccctcgcttgtatctctatatatgtgtatactatattcatattcatgttgtcaaaatcggtcacgtggtaaagggtctggttttttttttttcactttctgctcaagaaaaaaaagaaacaataaagaagtggtataatatcatcatggaacgctgtacgggacgatgtgggaagcgacgtctgaaatccagtaataataaacagtgagcactttaggatagcagtagtttgcattttgcacgtttccctttccatgcaatgtttttacctcgtctcgttcggtacaggaccgagaggtttataaaaatggtacctaccaggaccttgcgacgaatcaaccacagcagcagggatccaattcaaaaacaggtcttggcccttatcaa

SEQ ID NO: 14143 - DNA, 400 bp, Saccharomyces cerevisiae
ggcttccaattggcccttctttctacgtatgtatgaactagcaattgaaaaaaaaaaaaaggtatgtgcgtgaagagaatctaatcataagtacattattcgtacttccagggaagatccactcactttctttatgaaaaagaaatatatttatctaagatcaaccgcgagcacgacagtgaaatagtattagtactccaccgtatagtaaacgattaagtaaactatatacgtccaccgcctaaaaaaactgtcgaaacagaatctctaaaaccaagacgaatcgtgactctgggtgtctattataaaagacattattaccctttttcaaaaaaccaaaaaaaggaaaagaaaagattttttaaataccaataaagattcttgcaccacaggaacttct

SEQ ID NO: 14144 - DNA, 478 bp, Saccharomyces cerevisiae
atattatgtacgtatgtatgtgtgcatatgtagtcgtaacctttcttgcttctgagatgcatacaattactaataatattctccaggtctatgaaaacatcacaacatactatacttttcgtgttcgcgttgtaagctataatggaaaatggacgccataacgcattacttaacaaactacagtttgtcaatagagttgtccagtagagttaaaaggtcaattcaaccggtcttcaataagacatgtcactgaatgacttcctaagttccgtgctacctgtcagtgaacaatttgaatacttatcgttgcaatctattccgttagaaacccatgctgtcgtaaccccaaataaggacgacaaaagggtcccaaaaagcacgatcaagactcaacacttctttagtctatttcaccaaggaaaagtttttttttcattagaagtgtatgtgtatgtcacgctttgggatgaagcagatg

SEQ ID NO: 14145 - DNA, 485 bp, Saccharomyces cerevisiae
aaggtttaaagcagtcaatgaaatagtatttaaatgaaacttgaatacaaatagatatgtacaattataaagaatgcatcattggatttgtagttgatatcaattatcgtaatgtttctctgaccggttcttgtaataccatttctttgaattttcttttttgtattttgtcttatttacgagggagtactgtgtccttgctagagatgaggtaaaaaaaaaatcttgaaatttttcctttatttttggccaaatagtgcaacaaacacggcatgtactttgaagagcagatgaaatgggtttagtagacggttatgacacaagctcagactctgatttgaacttcgacgaaggcaaatctgttcatgaaaagaaaaatggtaatttgcatgaagatacttcgtatgaaccttcttcaaataatattcataagagaaaatcacattttacaaagtcagaactaaaaagaagacggaaaactcgca

SEQ ID NO: 14146 - DNA, 490 bp, Saccharomyces cerevisiae
gaggcatcgcatttcattatggtaatttttatgacttttctatgtacatatttagtgaaatatacgtccgtagaaaaaaatggccaaacatagttatcctttcaaaggttattcgcagtagattttatgtcacctgtaacttccattactattgctattatgtggttaattggcatcacatccgacgaatttaataatatgaaatgaaaaaaacgaaaaataaaaaaatttcacctcatctcatcgatcactctggtcctgttgtggtatcgttcttgaaagtgtatatcagcctacattagtgcgacaatgacaatggcaacaaccgcaatgaatgttagcgtacctccaccagatgaagaagaacagttactagccaaatttgtattcggtgatacaacagatttacaagaaaatctcgctaaatttaatgccgatttcattttcaatgaacaagaaatggatgttgaagaccaggaggatgagggat

SEQ ID NO: 14147 - DNA, 470 bp, Saccharomyces cerevisiae
attcaggcataacgttttcttttataagtaaagtagcgttttcttgcttcagctatttgttgttttatttttgattttgtatgtacatgaaatgagtttctacataatgaatattttttttagtaagggtgctccaatcatttttttttcttccccttcccctttgcagttgcagctgcatccttcttcatcttcttaggagcacctttaccacgacgtttctttgcttctaccatagataatcgatattgctcctcaaggtctacaaattcaatatcaggatataatgttttcaaatgtctgaacttcaggatatccggattgccgtagtagcttgccacagaagggccctttaatcgctcatttagaatcttagaaccggttcttatacctgatgggttgaaattttgatcaaatatcttcgcagataactctgctacttttaggagtctcgcctttggtacgttcat

SEQ ID NO: 14148 - DNA, 428 bp, Saccharomyces cerevisiae
taggtaatgctcaattttatatacgcatatgcaccatagtaatttaatattttttttccgaattacaacaattatattataatattcctttcttttggagctgctaaaacaaagaatcataacaagatattaataatattagtaacacaaagtaaaagaaaagtttaataaaggagcaatgtcatcttcattaaaaaagtatacaaaaactagtcacttgaatcggtaatacctttttcaccaattacgtagacacattctttttcaggcatatctggggaatcttgtaacttggcaactctttcgtcaccacgcccttttctcaacaaaatccttgttgctgacgcatgtgccagaacgtgccctccaattggtttcctaccatctgccgaggcaaataatgcagaagcacctgggtctgattgaac

SEQ ID NO: 14149 - DNA, 484 bp, Saccharomyces cerevisiae
cttcatcaaagaatttttcatccacaatttttgtattttccttcttttttatctgttcaatttcataaataatatatatgtacaatgtataaacgggaagccatcacttataatttatcatttccttaactttatagtctgggtgagaatatggttgacagtatttttacaagttagcgcagttttcttgatatgatggaacattattgtattagtagtagtcaggtttgcaggcttttccttcgagcacaacgtggcattatatatagcatagaagagatgcgaaagatggtattgaacaaaaagaaagtactgtcttattgtattaaaagcgactatatagaaaaattataaaaaattttaaatgttagaatatgcaatttcttctaaacagtgcggcacttctaatcaaataaaccgaaacccatgtcgtcatcggattcttctttagcttcttcttcttccttttcagcttcggcttcac

SEQ ID NO: 14150 - DNA, 458 bp, Saccharomyces cerevisiae
tttttgagctttttctttccccccttcaagtaattatttagaataaaaagtagtgtttaaagacgacattttggagcatgcactgtataaccaggttcaaaaaaatttcgcctgctattgttttctttattttgaagatgtgagaaaagtctcatatctagtgagcttcagtctgtttttagatgtagttagcaattactattttaggtatttctttgcgcggttacggtctcaagaatttatattaccacaaaacctatgtaagctagatcttcttagcgaaagtggttcagtggttagaattcatgcttcccaagcatggggcccgggttcgattcccggcttccgcattttttgtgcaatttttttttatactctattttcaagttaaagtttttcaaaggcgaagtatgtttacgctaaatcaagatatttggatgagcaatccactaattgcg

SEQ ID NO: 14151 - DNA, 482 bp, Saccharomyces cerevisiae
tattagaagcccatgtctctcaatccgccggtgttacaaaagcatggcgaaacaggcgtgagatatttaatcttccatctcatctgtatagcaaataaaatgtaattataatgcaagattctgagcaaatgaaccaagcggttttagtacagctaggttgactttttttataatattctattttacattttatgatatacttatattatttatatactagctttagaaatgatgaagtttcctacattttcatggtttcttcaactccgccatttgatgtctcaacactcttctgcttcattggctgcgtttcctttaataatagaccgaacctcttatccttggccaaagtagctaattgaaagatcccttgaacaattgaatcttgtggatttaattcgtgctgagagtgaatccagctcggttgacaggtcttagaaccaccagttaatctcaataattcgggtctgtccgttgtactt

SEQ ID NO: 14152 - DNA, 438 bp, Saccharomyces cerevisiae
aaaatggagtgaaaactaaagtgagtcttgaattctgtacttctcattatacacttctgcatttgatttttatttcatgatgaagctgtgtgaatatatatatatatatacatatgtcaaagtctagtgtaaattgatagaattaacagtatcttttaatatccctaaacttcaaaattcaaggttcaacgattgaaagatgagctgtctaggtagtagtaccgaaacctttcgagttttgtgctatctctgaaaactcattatcctgctaaaccctttctaatgtgcatagcagctattgcaactttagcatcctcattacagacggcatagcagagacgtatgcggttaccccccagattttgcctgtttcttttcactatgaaaaattttccgccataagaaaaaatgaagtagtgcatcgcatctcatctcatc

SEQ ID NO: 14153 - DNA, 403 bp, Saccharomyces cerevisiae
acatagtgtttaaagattacggatatttaacttacttagaataatgccatttttttgagttataataatcctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcgg

SEQ ID NO: 14154 - DNA, 448 bp, Saccharomyces cerevisiae
ttaatgtcttaaaaactgtaatatcatagtatatatatatataccacagacaatgttattcaacaataataaagtgtctttttttctgtgcatcaacaaggtgacagaatgttgatgtaacttctttccaccaagtgaatctacaagtagtagaatagagtatttatattcggtttacaaactacaaatagcgtgctcatatctcttttttaatgatttcatttgtatgagtatcgtctttcgtagctcttctaacgtcaataatcttaaaatcatctgaaaagttgacatgctctgacacaggaataacagtctctacttttatctctggcatatttggctctggaccatctttgataagatctataaaactatcttccgagtgacctagaatacaatgcaaaacgacttgggcgccaggtttcgacaggaccaggctgttttcctt

SEQ ID NO: 14155 - DNA, 413 bp, Saccharomyces cerevisiae
tttgaactaatataatgcgatggtgtaaatgaaattcaatatttcatagttgcttctcaaaacctgcgtgaaaaatcagcatggaaaatgcaaaatgattattaatactatgtatattttaagtgcaatatatttacgtatccttcacgtgttttctaaaatatgtaagaagcttgccatttgatgaatactgttcaatattctccaactgtgcggaaaacttactgatatccggcttctttgcagggagttgtttgttcttcaattctgattcttctacaatatctaataaaagcacatcatcccttaacccgtataagtgcagtagataagtacccaaatcctgtaagcttaactgtattaaaattattccactgagcttttcttctgatacggatagcgatgaaacattg

SEQ ID NO: 14156 - DNA, 436 bp, Saccharomyces cerevisiae
cagatggcgacgttatgcgcaagaatttcatcaggtctggtacttctaggacttcatcaacccttctttaaatacttattttgttattagtattatattttcgagattgtgctatgtatatatatacgtagataagcaattgttatctaatcaaggatattatttggatgatttagaagatgaccggcaaaaaaacgaaataatgctgctatataccttggctaatcttcctctcaagcgtttcagggaaagacgtgtgtgatggttgaatataagtgaagcaaatggccatgagactaaataactaaaacggccgcaataatacacactattgtaacctcccaaagtcgttaaccaacttagcagttgtcttagtttatacccattcgcactcattatcattttgtaaactggataatgtagggcctcgtgaatg

SEQ ID NO: 14157 - DNA, 443 bp, Saccharomyces cerevisiae
gcggatatcagccagaacatatacatttataaatactgatatatatacactcttaatgctttattcgagcgaaccttaacagtctgaaggcagattaatttgtcaagtgcctctcttttgttactactaccagaaaacatgaaaaatgtatgtgcgatgcccagaattttacctcgcataaatgaaaaaatttcattttaccagtagaaaatacttaacctaaacagacacaaaaaacaaaagtgaaagcattatagaaccgagaatgctggtagatttgaatgtaccgtggccacagaacagctatgcagacaaagttacttctcaggcggtcaacaatttaataaaaacgttatccacattgcatatgttgggatatacacacatcgccataaattttacagtaaaccacagcgagaaattccccaacgatgttaagctgt

SEQ ID NO: 14158 - DNA, 401 bp, Saccharomyces cerevisiae
ttctagcgcggcgtcttctcaagttccggcttcgacctagccagaatgtgcagcagagtaaataatattcacttccctgttcctaaagcgtacaatatacaactccaacttcatatcaactaccagaaacagtaacatacgtaatagttattttctatatttttattttttttttgccactgaccagtcttcgcggcggtgtgagtttccgtctgtacgcagcatttagcagagatttgccaatgccaagaaactccgctaaactaacatcgcgatgcaatgggcttggtattccgtggaagaaaatgaaaaccggctgcaaagaatcctccgagaaaatttgatgcggtgcacggatttcagcacgggtttcagcacggattttatttctttgcaccccg

SEQ ID NO: 14159 - DNA, 448 bp, Saccharomyces cerevisiae
actatttacaacgtaatgattttataaactgattaaataaggaagaaagcccaaaaaattggaaaaaacttaaggaatttgtgcggatagtatctgaagaataaataagtgttttcataagttttgaagttacaaactagctcgtttagtttgtatatgacagcctacttctctcgcttggtaaggttttaggatccttgtctagagcttcatattttgcaatggtcttggccttcaactcttcctcttgctttggtgtcagtttttcgaccttcaccccaggaggaacaaacttgaatttacctgtggcaaactctctgtctgataacctgcttagaacatatagttgagaataaatgtatctcacaacagactctaaatgaaccatatcaatgttctttcttccaccaaaaagatttctccagacagctgtcgcaagtgtaccatc

SEQ ID NO: 14160 - DNA, 469 bp, Saccharomyces cerevisiae
ggcaaaatatgagcggatagtttgtacacatagtgtccctaaaattcctattgatgaatagatcaattttattagcagacaattgggggcagcaactgaatagcagaagaaatttgagttcaattatttttttttcctgtcatacataatggcctatttacaggtacatacatatagagtatgtatataaaatctctgttgaagaagacatcattcttagtccttggcaatcttagccaggatttcagcgtccctgaaaagaataacttcatcgtcgttacccaatttaatggtagaaccaccaaactgtggaatcaaaacttggtcaccaactttaacttgaggaacaaccttattaccattagcatcagtaaagcccgggcctacggcaacaacttcagcttggtttaacttctccacgttcttttcaggtaaatacaacccggatgctgtctttgcttgtgccttg

SEQ ID NO: 14161 - DNA, 493 bp, Saccharomyces cerevisiae
cttattgattaatgcgtagaagaagcttttccgctactattcctttcgaagaagaaataaatgtttagtacggcgagacgatgtgatcaattgaggttattttactacttttcctttcatttttgtaaggttttctttctttgttagtgtgacgttggtatttacctttatgtaactatatttatgacatttcaacatccgcttcttctggactttctgcagcttctttctctttcaactcttttatcaattcagcagttttttcgttatcatatattttgaatccgtcttgctttgttatacaactcaattgcgcgttattttcatcaagtttctcttccatcacttgctttaggatttttagaacaagaagctcagcttctttcaaagttaaagaagaatgccattcattcaataattctgcttgtgctccttcagagcctgaaccaatggctttggcattataacggtaaaatgtcccagatggttctgc

SEQ ID NO: 14162 - DNA, 407 bp, Saccharomyces cerevisiae
tgagcgctctgagtatatttaatgaataataggtctatactataatacatcaactactgatatcaaagtaggcacttagaatcaaaaggcttccgaaaatttgttcagtttttcactttactcaatctcgtcactaaagttttctttttttttcgaatgaatcctcgaataaatatgttctatattatatatatacatcttttatatatcattaaatgtacagtaatcggtcaaattacaaatgcttacggatgattttttcactgattaagtactcataaataatggtagcacattcttcaaccgtcttctggtcggttctcaaatgtagctctggagcttttggcgcttcatatggggcagaaatacctgtaaactccttgattacaccctccctagctttcttg

SEQ ID NO: 14163 - DNA, 485 bp, Saccharomyces cerevisiae
aatgatgcataagccctttgtaattttaagatatatttacttactctttctcttaaagaaaaaaaaaaaaaaagaagaacaatttatctatacctatatttatgtttatgttccatcatgtagaaaagtttcatttaaaattaatagcccgtcaaaaatacaagtgaaaaaaaataaaaattaaaagctctctatttcttataaactaacatagcaacgttctctaaagaaacatcggattctacgtaccttatcagctccgcattaaactctgtaaacttttctttcacatataccaacctgccctcgtcgattacacgcctagccattaatccaatattttctctctctttaatggttattgtatatggctcagccccttcaaacgattcgacaacgtttactatatctgtaatagccgtacctggtttccttccgcaggtaccccatgaacagagtttagttaaaacgcggaaaaaggtttc

SEQ ID NO: 14164 - DNA, 428 bp, Saccharomyces cerevisiae
tgagcagacgacagattttcatatcaatgaagtttttttacaatagtttacaaatcatgattttacatactcaaatatgtgcaggttgatacagacaacgtacgtagaagacaacaaacagaaaacagcggtttatacatttatttaaatgacatacagtggagaagcagagaaaggaaaaggagtgcgatgagaacagaagatgaatacttcggttgtgttggttccacgtacacattaatagcattaaaaattgatcctctgaaattacttatgagttttacgtcttttggtatttggcgtttttccactggcaccaattgtaatgttaacctttggagggactggaaaaccgtaagactttgctactttggctaaatccagcttatcgatttgatagacagttttcaaagagtgggaagcgtacg

SEQ ID NO: 14165 - DNA, 493 bp, Saccharomyces cerevisiae
gcaccaaatttagttgtttactttgcactgtcgcattatttttctataaattgagctttttataatgagatatgatccggaaacagctttctgaagtgcatatgttatagttaatattaagaattttttgagactttattatgttaccatgattgcattatcttttaatgttaacagtaacaagtttacgtatcgctttaaaacataattacattcagaggtcggaatttagagccaataaaatttttagagcatatgttgacggttttaaattactcccaactgcgcaacaacaccttattttctttttgccatattttaatatttattagcatttgggaaatatttaaaaaaagaaaaaaatcagctttttatatatttcttttaatttagtaaacctcattctcttttcctacataagtaataaaacgttgaccactctatttttaaaggtacattcaaatcttcacaatgacagatttctttgagctcg

SEQ ID NO: 14166 - DNA, 430 bp, Saccharomyces cerevisiae
ataagcattccttttataattactctaacttctcgtcgtactaaaaaaaaacacttttatagtaagatataaaacaaaaacgaagattgaatcttccttttttatttctgtgttaaattctctaaaccagcttgatttgcgcgaaccacctgtcacggcagatcatccgaagacgacaaagaaaaggatgcattacatcggtttaaatttttctattcgtattttataagtattatattatattattaagtcatgcagatataaaattatacaattggtcggaaatggagggaaatcatacatttttattttatttttagcgtagtagttttatcaaaaaaataaaagaaaattaccatttcaacaagtcatccttagcgtataagtagtcatcaaagatcaattcgacttcatcggtttcagcgttgta

SEQ ID NO: 14167 - DNA, 451 bp, Saccharomyces cerevisiae
ataaaacaaggaataatttccacatagatatgcaattaagttttatatgtaaaagtgagcattcatcgttcagctcaaaatacgtttcttgtcacagctggtagaaaaactatgagcgttttttcttacccgcagtcggagaaaaattttttcttcgaagaggcgaaaaagagaagaagagaaagcacaaatctgatgaaatagtagtataaaatcgcatttacaaattttcaaccattgtttatttcctaggtcattaaagagtaaagtgcaatctgtttactaatcagtttttgtcttcatatttttgtgtcttttctgctgcctcacgcaccttctataatacaccaaataatgtccacttctcattgcagattttatgaaaacaaatacccagaaattgacgatatcgtcatggttaacgtccagcagattgctgaaatgggtgctt

SEQ ID NO: 14168 - DNA, 464 bp, Saccharomyces cerevisiae
acattttaaatattgttatctgccctctcttcgtcttttgtttaatataaataaattctaaatcaactatatatatgtatgtatacatatacatatacatatatcaattataaaaaaagtgacaagcattatacatacaatttttctttttttttcatgaaatgtgtaaccagtgtgcctcattagagacagggacgagagagcaaaggtgcaatttccgctgcaaatgaacttttttaaacgatgtgcataaataaataaaaaaaatggcagaatactctaaaattgagaaaagtaatcccgtaataactttttggttgaatcaccaccataatgggagcagtcattggtggtcaagttctccatacgtaatcctaaatcatttatgatagaatttacggcgtttaatatatcgagttccataaaggaatagaagataacatgaaccatcttcgacggatcag

SEQ ID NO: 14169 - DNA, 490 bp, Saccharomyces cerevisiae
atataacataagctttacgagctgaatactaagtagtttcatataaacgcaaacataatcttggctgttgtaccttttctgcatactcttgactgttaatacatttcttatttttcttatgaaagagcacaacatgatagcgccatactatcattctgaacgttgcgattaactggaaattacgaagactaagacaagaaaaattaaaagcgttaataaaaaataaacaaaggaacctttgaaatatattccgtcaccaagctaagaaaggagtagctctttctctaaggccaactttgtcatcctttgagttagtttaaagtctattaatatttgctattatcttctgggctggataaataggacttttctattggcacatttttttctcttgtagaaggtcatcacgaatattaattttgtatttgaaagcattttattttctcctttttttattaccataatatacctggtactggtttttacctga

SEQ ID NO: 14170 - DNA, 432 bp, Saccharomyces cerevisiae
taccgttaagaaaatttcaagattttttccagaaatctcttcacttttctttgcacatctattgtattaaaaaactttttacttacatatactgtatatcttcctataacgggtaaaacgttaatttagaatcattcccaaaacttcatttccttatcatgctttgccatgtgatgcccaatagaattgtcttgtgcgttcacgaaatgactacactacgttcattttccaacaaaaactcaatctttcgctataactgctaatttttttccacttccccttttttgtttgttttgttcgtttgaataatacaaaatctttatataatctatataaaaacgtatcttttttcctttattaattattcaaataagtggacggatcaatgccttcttctgggaattcagcgattttgacatcgaaacgctcttg

SEQ ID NO: 14171 - DNA, 497 bp, Saccharomyces cerevisiae
aaatagaaagccagtatatgcacacgcacatatatatataaatatttatacaataatacaaataatcgtaacatcatctctgtcaaattgacgtggtgcacggcgcccagagaatgcgctaaaaattttcggatccgaaattttctttccttttaccatcgaggcaaagcaacctgtattatttatttgtttatttattaatagaaaagaaaggagtactttcgtggtacgctttcttgagcattttcggtttcactaggcagagaactaacacaagagacacagcaaacatcaaacaaggttaaaacagcacaccaaggcaatatgatgcattttagaaagaaatccagtatcagtaacacgagtgatcatgacggagcgaaccgtgcctcagatgtcaagatttctgaagatgacaaggcaagattgaagatgcgtactgcttccgttgctgatcctattctagacgctgtgcaggaagcccaaccttttgaaca

SEQ ID NO: 14172 - DNA, 421 bp, Saccharomyces cerevisiae
atataatcaccccaaaaagaaaaaaaatttgtcaaattttagtttatattcatttgttctatttacatatgtaagtttttccttttcttcttttttagttttttccttttaaaatttcttcttctgcaattcctctaaatatttttgctttcgtcttaacttttccttcagaatgtcatctccagccttcattttgtcattccattccactattcttcgcaatatactcatcacggtgagtatacatatataaaagtagatgatgaagcctgaaatgtaaacattcctttggttatatgcccttgaagccagtgcatccactggggttacactatttattatatagggatttttctggttgcggtacgtagacactctgatctgtgaccttttccatgaatcgatgaacaaaagaccaacg

SEQ ID NO: 14173 - DNA, 481 bp, Saccharomyces cerevisiae
atcattttataaataagaactccgagatccgagagcatataattcttggaactggacaattgtgaataatgttctgtatgtttataattacgtttataaaactatcgtgtatgaatgtgaaataaaaaatgctctattatccttaatgctacataatatgaagaaaaaggttgtaatgaaaccattagtaaagtagaactgtcctggccaatgaatgaaacttcaaacctcggagtttgttatgggaattaattatggcctaaaactctcgactctatcgaataaactagtttcattgtctgttccatgaaggtcaaacacatgattgtatgaggtgcgattctgaacacttgagctgcaaaacccttatacaaagcggttacaccttcgattctaacagttttgaccaaacaatctataggtcccttgtacaagtcacctttttgattatagattcttgtcaaaatgacatcccatgggt

SEQ ID NO: 14174 - DNA, 424 bp, Saccharomyces cerevisiae
gactagctgtttcgatgctaaagtatatatatatatatatatatatatatatatatatatatgtatatacgcacacatgttcacgtactataaattaccttttgtaaattcaacagcctctttttctggaactggaagaatccgttaacttcaatattccagtcgatgaaacggtttagaattgcaattgacctcaaaatcattatgttgcagttatccaccaactcgggtaacttcttcaactgtttcgtttcaatatttgcgtctttgaaggaaatctgatccaatgaacttttactgatttggcaaaactccatatattggctgtttagttcgtcaaatgcactatataatgtataaatatcgtcaaagcaactagcaaaaatacaaatatcatcaggagctcccacgttctcgatgtctt

SEQ ID NO: 14175 - DNA, 489 bp, Saccharomyces cerevisiae
ttatgttgcataagcgcaactataaaggcggccttgattgtttaatgtactaccagtattgattcctgtctgaatcaaaaactaaccttttggcgaggtggcccattcagttttcttctccataaattgtataaatcagtatgtaaggtctggcaagtacttataattcacatttcaatgtctatgtagcatgcatgatttttattataaagaaaaactattcgcctaagcgcgttcgtttctttcccactaattgcgaacgatttgcctatataaatacttaacggcaccccaatcatccacaccctctgaatgccgttcttcaactacttttaaatcactctcttttagtaataatttcaaaacctctcgttctttggcgtattttgcccttaaaggtatttctaggtgacaggtccctgatgccgccaaaaacttcgatatcatgttaactacccattccggatgctgaggcgaatatatcgggtc

SEQ ID NO: 14176 - DNA, 496 bp, Saccharomyces cerevisiae
atttagtaggttgaatgaactgagattttatacgaagatctttttttttatagcattacaacacaaaatgaaaataaatagaatctcaaatatatatatatatgtgtgtgtgtgtttatatatgtacaatgcggatgattttcattatagtgaatttgagaaaattttacttcgtaagcacattctttatacattcgacaatgtacttcgccaggggaccggccgtcgttgttttacaggtaacattaactgttccatttacctggtattgtatcttcattaaacaaccgaagtttccctcacttttcgtatgaataatacccgagacaaacaatgtactacgaacactggtctgatcgactatatcaaagcccaacctcttcactgtttgcgtcaatagtagaagtccgtcttctaaactgattgtttcaacttttctaaaatccttgttgagctttatgccagatttttggtattctccctcttttcccaaagc

SEQ ID NO: 14177 - DNA, 402 bp, Saccharomyces cerevisiae
tactgtatattttaaaccaatgcactcttggcactttaaaagtaaaggtataaatgtagttaaaagtttttgttttgataattgaatgttttcatttcgctatccccacgctactttatttacttcttcttcttcacgacaaaacattaaaatttacactctataaaaaacaatcatatttctatttatttttgtgagttgacaaatcttatcatagtgattagaatctgtaaaccgatctcaatcgtgtccagaaacagcgtgccatccctttggaatgttttcgccagtttattttgcaaacccgagaatcctgcacaacctaatattacaatgtctgaatcaagctttttaatattttcgcgatatataatttctgctatctgctggaaattttctgga

SEQ ID NO: 14178 - DNA, 489 bp, Saccharomyces cerevisiae
gttgctaaatgaatacacagcgtgttttttttactgtataattaagtaataatcatattagatataataatttctttagcgccatttttttatatatgagaactaccctcttgcctgaaatgcacaccttcaccaggcgcacactggttcaaaaatagtaaacaaaatcatgcgaaaatacaataaaagacgttaacttgatagaatgaaagcgtacgcaaagaaacgtatctcttacatgccatcgtcaccatcacaaaatgttattaactttgaagaaatcgaaactcaaaaagaaaacattcttcccctgaaggaaggcagatcagcagcggcactctcgaaagcgatacatcaaccactggtggaaataaaccaagttaaatcaagcttcgaacaaagactgatagatgagctccctgcattaagcgacccaattactttgtatcttgaatacataaagtggctgaacaacgcctatccacaagg

SEQ ID NO: 14179 - DNA, 422 bp, Saccharomyces cerevisiae
aaatattgaataaaaagaagaggggaagtcgtttattcaacgtttccctatcatttattttctattatattatcaatatttaatctatatataacttacgtacatgcaacaactacaataacaaaagaacaataaaaaaagaacatatatcaagaggcaaagacggaaaataaggcactgatgtgccaatctaggtagatttttcgttatccttgaaatagcactgttcgaaaacaaaatcgcattgattcgtcaccgcgcggtagccgttaagggttttgtttacacttactatgacatataaagatgaggggagtagatcaaggatagcgcatccacctccaaaagcatttttttacttatacatcgtgtcatttttttgaatatctatcagaagtaaggtttgttacggagctatggcc

SEQ ID NO: 14180 - DNA, 472 bp, Saccharomyces cerevisiae
aaaaaaaaaaactttacttagatatgtacatatgattgaaataccattttattcttagatgttttttagagctaatatagtagctatggcggaattaccttgattttttcggcatcacaaagttcgagaacacatcaaatcagcaaaaaaatctccgcgacggggaattgaaccccgatctggcacgcgacaagcgcccattctgaccattaaactatcacggattttaattgttgggttaacggtgtttttattaatacttgtttcatatgatttgaaaaaataaaaaaatgttgcagcaagtgatcattaatgtcaatataaataatgatggtagcaagatgagtgtttacgttaatgtacatttcatatactgagaaataggtgaattttcgggataatcgttaggatttcattattgttaagggctataatttaggtatatcgaatatacgagaagttctgcacgatg

SEQ ID NO: 14181 - DNA, 404 bp, Saccharomyces cerevisiae
catgtacaaataatatgtttattaccctattatatgttactaatgaaaaaaataacaattctttatttatgtacaatgcaagtagaattccctaaatagaagttaactatttttattttactgggatatatttttcatcttcttccttcatactcctttcatttttcttgtttttttggcttacggattttggcaatgtttatactttagaaaaaaaggaaactcataatgctggcatacttgaaaaaccatacggaaagatcgtagtttatttttgtaataagacactgaagtcagctgtttgaaagagtatattgaattgatggttttacctattagggatagtaatcataatttaaaaatatgaaacggttcttactcagtcgaagacagagacaccttcg

SEQ ID NO: 14182 - DNA, 448 bp, Saccharomyces cerevisiae
agcatttctttttggttcttagtcaatatcgaattacacggaaccattggtataccgtggatgcgccagccacaaattgacttttacagaaagtacagtttaattatataagaacaggcacttaacaatgtttcggaactctgtagataaaaccaaattactctttcgaaaaggctacattctacatcaaaatcacctgtgcaatatatatatatatatatatatatatatatatgcacatattcgttaatttcttcacttttttccccaaatattaaacagatggcttcatttcttcaacattattttctggttcctatgccatttttagcctactaataattatcgttgaaaaatgtttcttgaataagtcttaatgtaaggatatatcatatgttgagatataaaaatttaagtataaatgaatcaagacaataatttacattga

SEQ ID NO: 14183 - DNA, 474 bp, Saccharomyces cerevisiae
gaattatgcagtctatcctcatggcattttttctcattagttttttacacgagtatcattttaggatattgagattatatgtatatgtatatatgtaggccataagatgattcaacggtttgtattaattatccggttccgagcgttaggagaaataacttggtgtgatatctgtcaagtggtcatccaaaatttttttggccagagcgtaagctacgtagactgatgaggaattctttttttttgccccattttatcccaagaaattcattatgaggttttgttttgttttactaaatgcgcttgatggaaaagcgaatgtcatgaaatgcagatcaacactccaataaaaaagtaaatgtttttaaagaagtatatcacgctacaaaaattcataagcactatatttcgaacgttaacctaaatctctcccactaagaaaatggatagaaatgtatatgaagcctgcagcaa

SEQ ID NO: 14184 - DNA, 492 bp, Saccharomyces cerevisiae
catcgtaaatacaagacacacacgatccgcttttcacgtcagagattattatatacgtacgtatatatgtaatagatattcacatgtaaaaaaaggtaagcatcctttcatttaagaaagtatggggggagtcatccgtctcacggattctttttcaaaatattgacgtcgtcaatttgcattctttccaaagtttttattcctagcagctttgtcatttctttgacaaaactaattgctacactttgcacatttacaacagcatcgggtcgttgttccataattgaagtagtcagtgtatttttcaaaccgcacatttcaaaactattcatatacgatagatctgtattaacattaattgctaccccgtgcgatgttatggaacgtctgacgtgtattccaacactagcaactttcttcttgccattttcaacccaaactccagtgtcctttgtagtcatagcatctaagttcaaaggcttgtcagtgtcg

SEQ ID NO: 14185 - DNA, 500 bp, Saccharomyces cerevisiae
tttcacactgtagataagaaggggatagagttgccagaaaattttttgctttatcagctttttagatttgtcttctcgttttataaataatgataatttagtacaataatagataataaaaacatttttttttgcaaattgaaagcttaactggttttttaaaagaaaatattagtgaccttctaccgactaaaatcttccactaaatccccagtagaaacataagataaggttgaaacttttttagggcgattatatttttagtcctatacatgtttgatggcatactttttaaggaagatttatgaagctatgttccacataggtttatgtgctattgatatatactataaataaaacgctctacccaagaaatgaaacattttttaaacttttgtcatcagcacaaaaatatgcggatttacgcgtttgtcattcctataaaccttaaccttaacgcgaaaccatatttcgctacctaatgttggttcggtgcattt

SEQ ID NO: 14186 - DNA, 428 bp, Saccharomyces cerevisiae
cataactaattggtaactagggttcattaataataaaataaaactaaaaaatatgtgtttatatttattctgctcgcagttaagtatggaaatcaagaaatagactggaaatgatctatattttcttcgtattttgttagttcatattatctcttgcggatcgtgacagtagcacaagaattcgatgttgcatctcataggaataaaaaagaataaaatgagatttatcacagttgtggctttttctccgctccctttaatattttttcgtagtatttaatcttctcttgttcaacctccgataaagatggtggtaatttttcattaataaggtcttcctttctagccttttcaaaagtgcttagcgtttcattcaaaccttcagtcccacgagctagagcaccacgaggtaagacaccggcattcat

SEQ ID NO: 14187 - DNA, 430 bp, Saccharomyces cerevisiae
tcgaggcaatctgatctaagtttcaaatattccgtagagtataaatatcttacaactaatataattcttaatatgcgcaaacaaattatggtgcgcatctttttttatttttatgttttgttccatactaaatgcagtttataaaatttttcaaatgagtcaagctatgtataatcagtgctacaaaaatgataagatgcaattgcaagaaaaaatcccttgcataaagggctttctgacctcttgcgttgatcaacgagaaataaccgcaaaacttaattttaaactcccgcgtctgctttacacagcccacagtagcatcaaaaactacgatgtaacactaacggtggattgtgaatacggaacgaacaatcctgcatcttgacttcaaaacttgatcatatacacctataccgccatggttatctcg

SEQ ID NO: 14188 - DNA, 493 bp, Saccharomyces cerevisiae
tatatttaatagtatgtagtagtagtagtagtagtagtagtagtaaaaataatattgatgcgcaaaaactcagcataaactcaaccggacacgctcacgtcgaagtaatcgtagccggacaacaggtatttcatgtcttctgatttggtgttggcgctagcagtggtcctggcagcgggttttgctgcgcgagcttgctgccgtttgaagatgcggtcgatctccagcagcgacttttccatgagcgacgcaaaccgagcagtctggcgatgccttgaggacaccaccacagagacggagtggtctctgatgatgtagccgatgccgaagccgttggcggtgacaggcccgaacccgaagctcttgaggcaggggttaccgcagttggaggtgctcaagacgttgttctgcatggtagtccaggacttgtcgcggaagatgggtgggagctccaacttgtccttgtaccattggttccagaggcagtagagcg

SEQ ID NO: 14189 - DNA, 428 bp, Saccharomyces cerevisiae
tctccaagttaaccacatactattatatatatgtattcaatctccttagcggtcagtctctttccaatttctttctctttacgttatcattgtcctttattcgacacttcggcgaccgcttttaaaacgataataacaaagcgaaatcttattgtaacacatccttgcttaattacatacgaagcaaaaagtgagagtaagttcaaaaacagcgggcaatcgtactcccaaattttgttgtacctcatcaatcggcttgactgcgatttaaacataccctttaaacatggatatatttaggcatacttttggaaataatgatgattcctttattcgaatcccaggtgcttttagagaagaaccacctgctgatttgaatggaaggacagaagatcaaaacagcaatacaaatgaacccacacagagcc

SEQ ID NO: 14190 - DNA, 474 bp, Saccharomyces cerevisiae
cagtgaacatatagtataacaaatcaagtttatatagttgaattgagagtgtctgttagctcttcgattgacggataagatgcatccgcgtcgatattgttgagattaggaatagtaccgtttatactttcctcatcagcgcggtcatcatcactactgtgagttagaccgccactcattgaacccttcgtcacgccatgtacgccttgcctatatgtttcttccctcaatggattaactacttcctcctcaccaaggtttgaagaaataccagaatccagttttttccgcacgcaactgttggtccacattcgccttctatatgagcccctttgtccatcaagattgaggtcatagacccattttgtttctgaatctatctcgacatactgaataaattcgtcctctacccattcttttggatccaaatcaagcacccaatgagaattggcttcccattcccaatccttaggt

SEQ ID NO: 14191 - DNA, 452 bp, Saccharomyces cerevisiae
ggtaaatagagaaataaaagaacagattattatgtgtaaggaattttatctaagaacatatttataaaactaactcatcaaagctgcccaagaactcggcagcttgctttgttaaccaggaattactttcattgtcgagataagccaaatgtccacccaagtcagtctcgcataacaacacacaaggattttctctagcttgtttgtacggaattacgttttcacctgtaactggatcatccgttgcgttgattattaaagttgggattttgatattaggcaatctatttatcgaactggcctttctataatatgttaacccgtccggcaggcccatcgatggggcagtgaaaagattatcgaattctaatatgtctgtaaatttttcagccttttccaaattttctctggtatacgtataaaagactggtttctcaactgtcggtttgtgc

SEQ ID NO: 14192 - DNA, 440 bp, Saccharomyces cerevisiae
aacgtataatcgacgcaaatatgtatagatacaatatgtacagaacaactgcattgtgcaatataacaacataacacaacgcccagaacgaaataaaaaaaataaaagaaatagatgaaagcattttcaatttgcataccggaaaccgtaaatcaattggcgtctagctaacaactgagaatgcgaatcgccaaattgttacagaaagtagcattccgttacgtgatctgtactttaacctcttggacgtaaagaatggcagaactctggctctagtgttctgcgaatgccagatcgggaaatatttcccaaaagggcaacagcggcacgaacaagaatttcgtgttaaaaatcgcgtccggcgcgaaatttttcgcggaggcatgcgacgcaaaagcgactcgaaatgtcgggagccaaatgaggctacaaggctgtgg

SEQ ID NO: 14193 - DNA, 496 bp, Saccharomyces cerevisiae
agatagatttgaactttattgatccaaaagaattaataaaaaagtttaaatctacgaatgaaaaatggaaatggaataatataaacttatatataaatgtaataagttaataaggcacaattgttgaacaagcaatcaaaatataatatttcactgagcgccgttagaggatagttatccttttcttggtatttcaagtattcagtgtctgtgtcgaaaaattgattgatgatttatttaaatgaatatatataaatatgtaaaaaagagttgatcaaagtaaataaatcagtacatgcatggcaaactctaaatgtatttatgttcataactggcacatgcttttcttccttatgcggctcttctaaattttgtaatctgcaaatttccttaaaacagtgtctaccacatcattgagatcatcttgtgatatatgaggcttctcagagccatatctaacggcattcctaataaggtcttccataatcgatccgga

SEQ ID NO: 14194 - DNA, 431 bp, Saccharomyces cerevisiae
ttttaatgtattgaaaatcacttagttgtatatagcctgtaaaagtgttgtataaaaatgcatctcattcattaatgtttagttccgagcgtgacgttactaactgcgaaaaaagttccttcgactagtaaatatcaaaggcgaaaacataagtatatgggagaattataacaagttaagtgatgatgataggataagataatataggatacatgttatatacaaactctagataataaagatgaaaaatgaaaaggaaaagaacatgcttttagatagtatgttcactgtgtttttgtcgtttcctgtcaagtactcgctcgttacgcatctcattttatattctttttagagtttaatcctggtggtaactggtttgtaacatttttgccattggcattaataatagatggaattggcataggggagtt

SEQ ID NO: 14195 - DNA, 499 bp, Saccharomyces cerevisiae
tgatattatcgattttctttagcatatgtaaaaaaattactgatattatataatgtgtgtaaatttcgtcaatagatgcaaagcaatcacggagaagatgaaaccgacagataggaacaatacgacaagggagtcgactctgaatccattggcttcgtccgtatataacttcaaaattgagcttgaagacccaccgtaaccagcctgtctggtggaagtgggcgtttgttttgcttgcttttccttaatggattgtgcctgtcttctcttctgcaagatacgctgacctcctggtggaactgaagctgccattcttatgatactgttgatcgataataccacctgttttatgctttgcgccccttaccttttctcacacgcacatatatctactctctcatacctcttatatctaaaatgtctcttttggccagttagtaactgaatgaaaaagtgaaaatggaggaaaaaaaaaaagacgaaatccaaaaggctaagg

SEQ ID NO: 14196 - DNA, 420 bp, Saccharomyces cerevisiae
tattagagattgattcatagagtccgaatatttttttttgcaatattctttatttttcacctcatctcaccgcctctcttttatttcgtcaaggtaccctgccttcatgtttttacgtttttataatcgactactttatatctataacgaattatttaattttcttcgatttactgtgtttctaccattttgcgaattcgtgccccatcatgacttattttatttaattgttacatatcaaaggacactggtttacaaacataaaaatgattgttgagaatgccaattccgcccacttactacttttcatgtgttaaatagtacgcataaacacgagatctgacttcgattgtttcctcgtcttcgtcaaacatcggtttccaattaaccatttcaattagctgaggaaccaaatggaac

SEQ ID NO: 14197 - DNA, 414 bp, Saccharomyces cerevisiae
ccgctatgttaaaaacagttacgcatactaagtagactactttatagaagtaataccaaaccaaaatctggttagaactgccttttattgtttaccttaatcactctttacgtaatgaaacctagagatgaaattttaaaaattttttttcacgaacataaagaataactcttctagaccatctcatctcatctcatctcatctcatttcatttcgattcttctaatttctttcattgagtaagagccttttgttttggctgatagttatagtcaatctacaatttatctcacaaaagaaatagactaagccaaaactgcaacgaaagatcaaaaaaatgagctatgagaaaaagtctgtggaaggcgcttatattgacgattctacaacgttcgaagcatttcatctcgactc

SEQ ID NO: 14198 - DNA, 487 bp, Saccharomyces cerevisiae
aagttcaaaggtaataaatgagcaaccactttcttcgaaatacaatattgaaatcagcatgaagtctgagcgtagtgtttattgtagcaagtcttgagcatattttataaactctatttatgtttgtatattcgtctatcaaatggttgaatatgtaatagggacaggagccattagcatgcctggcttcaaggaacgtttaggtcacgaatgtccaacaaggtttcctgcaggtttccatatgtgaactgaattatcatttgccacactgcacattaaccaagggtcatgagcgtcccacgaaatgtcgttcacaccgagcatatgaccaccatgggtaaatatagtttcttcgcaggaggtatcccatagcttgactaacccatcttcttggccagccgttgccaatacagtatcgaaatttggactccattctaaagttgaaacggaagtaccgtgctccatggtagcgattgggcttttgttc

SEQ ID NO: 14199 - DNA, 479 bp, Saccharomyces cerevisiae
ttatttagtaatatacaatagtggcatatagataggtgtatttcctttttcttgttccaagaatccggaaaaacagatgctcttttccgccctataaaggggccaatggggaaagtgcagatcatattaacttgctaaagagtcagaaagaaccaaataataaaaagaagaactaatgttgtgcgccatcaaaagcacaggttatcggtatcctcgcacgggagccttaaatctactacgtggacgaccatttaatatggccacccgaaaaataactactgaaaggatccccggccctcccaagctgccaagagaagagcaggaagagttcgaaagacttcagaggattgccacatcgcaagaggcaatagatcagtataatgcgcaggccaccggcgatcgtacaaaggagagtttgaattcaccgcttttaaccaaaaacgatattgggtcattctcgcctgaattttccaagacca

SEQ ID NO: 14200 - DNA, 475 bp, Saccharomyces cerevisiae
tagccgccctgttcttgtctttctctctccttctctatatatatatatttacttaatacaatatcatattctctagtgtcgtacgaatattatcatttatttgctggcttttgtagtgagtatattttttgtagagaaaatataattactggaagagaaaaagctactgaaaaaaatttcgtaacagtcaccaaagggcaaagtgagcaacccaaaaatggacgctactcaaccgcaatacgaactatccgtagtaacacaatgcctaaagtctgccattgacgtcatccaatggttgattcctactattactaagttcagccaatcacacccgttagttttccaactattgtttattttcttcacattttatgtcttttacaagttgttgatgaacttcattactctggtcaaaagattcctgtatttgacgttggtagtaacatgtatcggtatttatatgcgtggttcgcag

SEQ ID NO: 14201 - DNA, 429 bp, Saccharomyces cerevisiae
acggtggtgtttgacacatccgccttcttaatgctttctttcagtattatgttatttttttgttattcgtttttcacttctaggctttttgacagactagccccgttataccaccatctttgtgggaaagcccctaaattgccctgagcagtatcgtttcatgtctagtctctttaaagatgtttcttacgcgttgcgtgtaaaacatcctctcattcaagacagggttttctaaaagcaataggggtagtttaataattcttatataatcatcatatacactatttttagttcttaattctttaatacaaacttattaatgtgctctccattgatctcttaatcaggaggcgatatataccggaagcggtgtacttttcttcacctcttactcaactatgttgatgtgcaagtttaaccactcgtcga

SEQ ID NO: 14202 - DNA, 453 bp, Saccharomyces cerevisiae
atggaggagatattcatagtgtcttttcttgtgttgtctatttattctaacatgattatatatttattatgcttttcagtgtttccattagttttatatgatagcatccttatgtcttttttcatacctatataagcaataagaagttatgtaaacagaactttgccactaataccataattactgtcttttagtatcattgtctgtcagtcggcacggatgaaaggtgacaaacgcctagccgccggagcctgccggtaccggcttggcttcagttgctgatctcggcgcggaaaaatcagcgccccacgccaaaaggttcgtattttttctttttttttctaatcttccatctattcggtagcgatgattcatttctctgaaaaaaaaaaaaaaaaaaaaaaatgaaaaagaatatttttttgatgaacttgtatttctcttatctggttg

SEQ ID NO: 14203 - DNA, 493 bp, Saccharomyces cerevisiae
agatgaattcaaatatgaaaaacatgaaaatacagccatataaacacgtaatatttttaccttaatgtttatggacagcctttttacttgaagaatgatctaacaaatattttttttgatacattcacattttttttttgttcatgatgttagcatctgcttagtctttttaaaattatttaatttaacgttttatttatgtgaacctttttttattagttgtatttactatttattcaagaatcattctttactttatattgatatcgtttttttccccctacttcctcctctggtgtattcacagctaggtgcttctcttgtcctcatccggtggagaaaaaaagtgaaaaataagtcaatggaaagggggaagggggtaggtaaatagagtgaataagttttattcatcatgcccaacttctattaatatatactcaattcaaatattgatcaggatttcaaagagtatgtcggagttacagtcacaacc

SEQ ID NO: 14204 - DNA, 426 bp, Saccharomyces cerevisiae
tggctgaaaggacgaggcgtatatagttttcgtgtacatagccgacagaatttgaccacatttagtttttccgcatagtcaattgacgaagtgaaaaaataattaatccaatggctggctttagagtgtcagcctccaaaataaatccaaaaatagacaaagagaatcactataattaccgccttggagtccaagttggcttgagaactcgcatttatttttagcgactgaggtagctgaaaaacgcctactttctcagaaggcggtagtgagcatatataagtatgtaagaaagatcaactcttctggactagatactcaccgatctagtgaaaatataaacaaacccaacatatatataaaatgaaggcctgttccatattatttaccaccttaattactctagccgctgctcaaaaagactct

SEQ ID NO: 14205 - DNA, 482 bp, Saccharomyces cerevisiae
tggctgatttagggttatatgtactattattagtattattattgttagtattattattattattattattattattattattattattattattattattattattattattattattatattattattaatactaaatattgacactgctttacgcactagattgtgcgggtaactgaatattttttgaaaatgaagaaaaaaaaatttcgatgagatgaccttagtaggttaatagttattagttgcctacttatagtgaaattcatagttctaagaaaatttagaacttatacctaaaagcatcttcaggctgaggattaaaaaaggaatatgagtgaacttgaagccacaattaggcaagccaaagaagccctggctgaaaataatgccaaaaaggcgctcaaaatattgaagccgttcaaaagttcactgaaaaaagaaaacgcaaacaatgtaatactgaatgaagtgtttgccga

SEQ ID NO: 14206 - DNA, 412 bp, Saccharomyces cerevisiae
ttatattaggaagagaatgaactgctttcaaaagaggaagacttctatgtctcgattattgcttagacaagtatggagctgacatccgttttcttttcagagcttttactcaacattctatgttaatttttccctttgtatatattcatttatccttataaattctactaaaaatcttttaatagtgtttgtatttaatgttcttcttaacaagggtatacataaaggttgattaaagcttaataattgaaatggaaaaaaaaataacaaaacgtctgaatttcctagtctgttttgcaaaaacagatgcgcaagccgggaatcgaacccgggcctcatgcttgggaagcataaattctaaccactgaaccacttgcgcgtttcaatcaatttgggaagactcagcacgtta

SEQ ID NO: 14207 - DNA, 409 bp, Saccharomyces cerevisiae
gaaagcgccacaaaatcgatgagaagtataaaaaaaaaaaagtaaaaacaataaaaataagaatgtgtacctcgatagataacttaaataagacaatttcagaaccacaatattgataacaccatcccgatttttgaaattatttttttggtgtaaatgagagaggaggggagtgaattagaaatggaaaaaggcttccttaaatggaaaccagtcaacttgatgaagaaaatattgtctttaccaatgaaaaaaactaaaaacgatataggtttgagattagatatatcatatattttagttaatctaatagtctgctcatacccggtaaacacgtatccaaaactgctttataggaatagcttggatgacttaatattgtttctaacagtgtaccatggcaagggaa

SEQ ID NO: 14208 - DNA, 446 bp, Saccharomyces cerevisiae
ttcggctaacccaaacttatataatcattataaacattttataaacttatacacttttttaataatctcaccatgtttttcttatgtgttttgtttgacaatgacattactccctacaaacatgtgcgcgtttgtgacaaaaacataaataaaacaaaaataataaaaagtcaagtgaaaagcactgaaatctaaaaaataaatacatatacatatatatatatatatacctatttcgtttccgcatagaagaaattggaggcaactagttgcaggttgttttccttagcccatttgccaacaccggtggcaggggtgccgtaaccccagttcggtctatccttaattttcgagaacttagatgagtccacgcccttaggctgcttatataacaagaaaacatatctgtggggaccggatcccttgggtggagctggtcccatata

SEQ ID NO: 14209 - DNA, 467 bp, Saccharomyces cerevisiae
aatgatgtttctatgtaaattaagtatatcattcagtatgtacatacaaaaatcaaattaatagtattatagtccgcgcctctggatagtattattttagtgcgtatcgcaaaatatgaatagcacagaggttcattattatgttctgagtatgaggacgaggtaatacataccttaaaatcttacatcatgtggatagcatttatggcttcttccatccggccgtacgcttctgttcctgtccctagccatagcttttctcatatcaaaagcatctttattgtcatctacttttttcagggtatctggatacccatcttcagctgagttataatatcccaccactctcctgtagacactgtatcccaatttttcgtaaagtttgatggccaattggttattgcacttgacgaaaagatcgataaagttgacttcatggggcatgacatcggtcatggtctccaaag

SEQ ID NO: 14210 - DNA, 480 bp, Saccharomyces cerevisiae
ttcgtttgttcaagaagtggtcaatataaaaaacgaaatcacatagcctttcatctatgctgcgaaagactgtataattacttttaagcaaaaatgtatataatatgatgggatcgttacgttggaacaagaattgaccatcgttcatctgttgttgaaataaaatttgaagttattcgtcgtactagtatcctatcacatgcggtgtaagaaatcacattgtatgagaagcaattatctaatttaatggacgctgaagttcaagaattggtaatgtgacaggataattaattaacagcatataaaataaaagaataatatttttattatataaaaatatcgatcactcttgtggatttctaaatcctcgaagagaacttttaatgcattctatatgcctaataataaagtcgctatcgaaaatataatatctatgcttatctatattgagaaatggatgaaatttgagataattgttgg

SEQ ID NO: 14211 - DNA, 438 bp, Saccharomyces cerevisiae
aggtcgacgtatactggtacatgagtgaaaaaatgattaaaggtgatgtgagagcacaaatgcaaaaatgcttatagggtttatatacttttataataacaataagaactcgttgaagtaactaatatgtgtatatgctattcttgtagttggcagtgaacacttttgtgtgaattgacgttatataagactgtagaaatatctaagaaaagagagttttcataaaacccttcaagcttaactaccaaaaagcattcatacttagaagttgaaatgcacgatgatgccaaattgatgaaaaaagctaaaaatgcatttcagaagggaagaaaataataagcaacataacagagggaataggtgcgcttagtcttgttgctgtaaaattaaccaattattcttgtattgttctaacgatccgaccatttcatcctgaat

SEQ ID NO: 14212 - DNA, 482 bp, Saccharomyces cerevisiae
tgaatgataagagacctatccgtattttaaatttataatctattattaaacttttttaaccaatatttttatttgtatattacactcaataatatgatttcccaaagtcgagtttttatttaaaacaaaagatggaatgattttgtaaacaaattttcttgaggaaacaaaaaatgtttaaggcataggagttgaaggtaatctcgttccttttgtctagttttcatcctgagctcttgaattttacctgaattttcccgcgacggtaagaactttaagggtctaaaaaagtaagttcagaaaactataacagctatatatcacaaaatgcatacctgatgcatacacagtaaggaggtaacatcaggtccgtggatatgttaaaagttcctttgagtgatgttctttcacagaagatgctgtttttaaaaagttttagatattttcattgcacaaaatacttcagcagagacaatgcatca

SEQ ID NO: 14213 - DNA, 404 bp, Saccharomyces cerevisiae
cttgattgatataggcagtttctacaattgtacctcttgtaactactacatacgttgatatatgtttacagatagctaagaatatcaaaatcatgaatatgtgcccttatgtgttctctgcgctgaggagtatcgcagcttcactcctgcagatgcatgccctacctactgtcatgcccatctctctcgtttaaaacttactacaccttttttgtgcatggattgtgctgatgtaagctgcacgaaatgacacgcttgtgaattttttcttctcttgggagaaactgtgaagaaaaaaaaaaaagcttcgcaaaacccgaattagtctcgaaggaagtaattaccttgtgaaagggtcttttgggatactaatttattatgaagtttggttttggtgttgcttg

SEQ ID NO: 14214 - DNA, 469 bp, Saccharomyces cerevisiae
caacaataaagtcttagcttgacgccttttctacttgtttgcatgtaatgaatctaaaaaattcgctacaaatacttcattattatatttctatataaattctgtaaacgaaattatactttttgaggtttcatctgcgtctcatattctttttgtataataaacgcacagacttgatatgaccgtcaatcaaaataattcaaagcttcttaaaaaagaaattgaaatcaaagacatacgaaagaaattagaaaatagaggtcgatttaccactgaacaatcctacagtacatgagctcttgaagtgactttatggggaccaatttgtcctatcgtgatattactacgggtaatactaccaaatgaaaattatcttactcaaaaggtatgacaagaacatcatcactagaacatcatcattcttaatagcaagcgccatcacgtttgccccgcctttgacagttgatta

SEQ ID NO: 14215 - DNA, 497 bp, Saccharomyces cerevisiae
tcggaatttttgtctatttggattgttccctctttattctttcttaaatgaaccactagtgcttcattatgtgccctttatacattacctctatattcaatcttctattataaaaatgataattatttctacataagccgttataagaatttaatgaaaattatgaaataacatacacaaagtgcacatgatcttataaagttttacttgtcctatgtttcaaagtatgagaaaattcttcatatcatgataatgttaggcaaccaactatatatgcagtttagaggcttaaagcaatactattacaaatggaagaggcgtcgtttccattttcttgacctggtaaaactttccaaagaactgtattgtccaatttctttccatgctgaatctgaatatatccaatcagttccgtcccaattatcattgatccaatgccaattattgggtaattcttcttcaccaagtccatctgggggcaaacaactcctcatggt

SEQ ID NO: 14216 - DNA, 418 bp, Saccharomyces cerevisiae
ctcgttaattatattttatgacatctgaaaatactagctgtactatatatggcgtatattttatctagttatgttcccatgtatatttaaatgccaaatagaaagtaatcaaacactttcgatgaaatacgtgctaactgtgtttcttccttaatgctttcacttaccatgtctccattctccattttcttcttgagtgaaaatgtgagtttataacgctcaagtacgttaactactctatttaatatcgtacgggatttttgatcgactgtaggttttcttcttagaccattccagcgcccgggtatttaaccaaacgctacggatgcacaataacttacaataagctcatcattagtcttgaattgcatccaaagttcaccaatattttgctgcggacttggcgcaaacgaattat

SEQ ID NO: 14217 - DNA, 443 bp, Saccharomyces cerevisiae
tccctcccatcacatggacacttttaagcacgttttgcttgaagagacattagtttacaccattataattgtttaataaatactagacatacttcaagtgagaaaatcaatcacacctttttcaatgattagcaaatctttattgccaggcctaactgaaacgatttattactgcgcaagaaaacaaagatggaaaaggctatgctagttcgattagttgtttccttattctttagaatattatatatgtatatataaataaatggctttcatcttatttcgaataaaaatgttttgggtgatgtgtattgagcatacacacttaatatcaaagaacaattataaagatgctatgaacggatgttatttttacctaactatgccttcttggctttgatacctctaatagcatttggaatgtatagaagtggtgtaacgacggc

SEQ ID NO: 14218 - DNA, 469 bp, Saccharomyces cerevisiae
aatactcgtggcttcgttatgtgtgcaactattcaaaagtacgtatatatgtatataccatctttttttacgttaaaatagtgaaaaaggaaaggaggaaagaaaaaactaatataattaattgtattatatatgtacttttcattttggaatgtgaaaaaattccaggcggaaaaaattgaaaaaatcaaacactgcgcttgtgagaaaagggaagaaaagcatcctaatgattaggcgcttgatgttgacgacaaacatttcgaagcataacactgccaatgatgagtgaccaagaaaacgagaacgagcagtatgtaggattgagctctgcagggcatgaaatggaaaaataaagcaacccattatactaacaatatgcacttagcaagtgcggtagatggtcagtgcaaaagcattcttaggattggctaaatgcgaagaagaagtggacgctattgaacgtgag

SEQ ID NO: 14219 - DNA, 475 bp, Saccharomyces cerevisiae
gtcaatatccagcatcgcagaaaacgcagaacttcattcagcatttggtaattttataacatataacttacaattaaataaaagtttaactatatattattatgtgatctaactctagaaaaagtactaatgaacatcacaccgtttattgttgggagaagtgttccatgatcatggacaattcatcagtttcagcaccccagttcttgacaacaacaacggaggcaccgacaacctttctggcgttaccttcacggtcgatcttacccaaaccagcccattcacctaattgcttagcatcagcaaccttgatcaatggaaccttgttttctgggtcgttagccaaaccttcaaccaacttgataatgttagcttcagtaacagagctgaccaaaacaaccaataaagcttcacctctggttaaagccttggtagattctctcaaacctctagctagaccatcgtgaaccaaagc

SEQ ID NO: 14220 - DNA, 402 bp, Saccharomyces cerevisiae
agcagcattcaaagaagaataattaaaacacactgaaagtgtgtttcttatatatggttatacattcatgaagatgagttcgtaatcgttatcttcttcaaattctgaaagtgtaaggacgtcaccacttcgtagctctatatatctcgctccaggaattacaacgttgttcaaacatgtcccattggacgaatccaaatccattacataacatttcaaaatgccacgaacgttcctgaactggatgacgcagtgctgctttgaggatgtttcttcgggtataccaatgtctgcgacaacgatctccgttctatcgtcgagatctgtatccagactgtggcccagttcacgaccgactaaataacagctcctgccgttcaaatcgtatcttttccacggtcc

SEQ ID NO: 14221 - DNA, 492 bp, Saccharomyces cerevisiae
gccaggtatatttttattttaaatcgtaaattcaagtcatttctataaaaaaaatcgtcaattttaactcaatattttatggccctttttatatttattttcaaatttgtcaaaaaaaggagagctaaatcattagaaaaagaatgcattatggtatatttatgtatattaatatgtaaaataagaaaaaagggaggctgtaggacctcggtcgtaagaacatttacctgtgttcttccgccttttccgaaagtgccatgaagaaacgcaggccaggcataatttcgacatttaaaatcacgatttgaagtaatttgaccaattcgatttctttacttttgtatcttcttttattatctgtttgtttaacccagttttcaagatcacagggcgcgctttactaaaattaaaaggcttaattgtcggtattggcctattttccttgttatcgtgtttggagtctatgttgtatgttcgcggagaaaacttgtc

SEQ ID NO: 14222 - DNA, 420 bp, Saccharomyces cerevisiae
cggttttgtatgctgtggtgtagggaagtgcctgggtctatggaatattgtgactatatacatttatacatgcggcccttttttgctctaacgtgtaaaattagccggccttttgtcccttttgttgtcgtgcctgatgacattttcaagcgctctattgttaataaatagtccgcaaagaaacttcctaacatgtggcttaaaccgatacttcgacatcatattaaatactttgaagaacattttctcgttttcaaaaagccttggaccgtatttattgtttatttctgtaatctccttcactgcgtgatttgaaaggatatgattgcctagctgacttactatatgtagtaccttgctctcgatggagtcatcgtcattgcggtattgtgtaacatagggagaagaaaggccttcgtt

SEQ ID NO: 14223 - DNA, 445 bp, Saccharomyces cerevisiae
tttgactcatactcttagattcttcaattatatatattttctttataaataacaatctcttaaacagattaaagaaactcaataattcattgcatttttagatgaaaatattactattatcgttcatcgagagaatcacatgatattatgagcgtgataggagggtctatatattttttggggtacgtcaaaaaagcaaacagacacgttaagaaggtaagaataacagatgatagaatgttttgctagtgagaaacaagtatggcaccagccgtacaatatgcatattttgacatttttcaaggtaaattagttccaagttaatagaataatcaagactaattgacttctcaaagcctcgcaaaaaaagcaggaaattcgaaaaaaaagccttcaaagaaaagggaaatcagtgtaacatagacgatggaggatcatgggattg

SEQ ID NO: 14224 - DNA, 426 bp, Saccharomyces cerevisiae
ttccacaaataatgcatctaaatatatacgtatgtttaaggttctggtatacaggtattaaaagaaaacactatcaacattcccaataagatataccacaccacgtgagcttatagaagcacgtgaccacaattcaccccacaggtgtggcttttttggtgccgtagaaaagactcattcatgaatcgtcggaaacccatagtcatcttcgagcaaaaggtatatataagcaacagagggcagtagttctcgagaccaccatcttttgattggaaatagtttcgtttagatggggtgcacatagtttttttcaactgcttttcctcgaggtcacccaaatatacaacgagatgccagttgagtttgctaccaatccttttggcgaggccaaaaatgcaacttcactgccaaaatatggtacacccg

SEQ ID NO: 14225 - DNA, 456 bp, Saccharomyces cerevisiae
gctttttaattctatctattcgcaaaacccttgtatattcgttaattaaattaaatcaatgtacaaatagaacaaaactagaaaaaagaatatatattcatctcaattctatttattttcttttcatgacatacaatggcattaaaagcgatatcgagttatattacattagcttcttgccgccagttatttatgaaataggccaatataacttttctgtaaaaaagaaaacttgacctcagagctttcattacacttattaagaacaacatacttgttgcactatagtaaaaactacagtgaaattgatctcaggatcattagtaatttttctcactataagaaaaaaaaaaaaacatatattttgctatgaattataataagtaaatatatacatatatatgtacagagaaactgacgaagaaaataaatcacccgttaatgcttcttaggtgc

SEQ ID NO: 14226 - DNA, 410 bp, Saccharomyces cerevisiae
agacatgcctttactaatgaacttccatagacattgaaaaataacgaaagaataaaaaaaaaatctttttttttttttgatataaatacagttgactatataaacatatatcaatactataagcctatatttgatcaagacgacattatttaggtgcatcaacaacggaaaagaaactttcttctaggctatccttctggggaagcagttgaaagtgctatccagtattattgcatatattcttaatgagtagtgctgaagtttgatacgtttggctctgttgcttttatttctcccacgaaaataaattgatttctttatttttcagtgtgttggcccggagttgtttacacacatgtctctttttggattaatgctgtagatcagggactatgcgagcgacaagtcag

SEQ ID NO: 14227 - DNA, 453 bp, Saccharomyces cerevisiae
aatgtttcgatccatccgcttaatattcattcattttgtatcacatacatacgtataaatatacataacttacctcgtctttattatgccaaccatcattccagggttttacgtaacagttcctctatggattccttttctaggtacttcccaatcagcacaattttacactctttattggatccgtcatatttgcctggaaagacatcgtaggtgtcgcggacgccttggattacacgagcaatggggttctctccttcaataagtatcagacctttagttctttgtacttcccaatcacggccgtcatctcggcgacgccctcccagcactgtcatggctccaaaattcttccacaataaaggttgcaaaaattgcttaataaacttattattatattcttcctcgttttttaatggtctgaaagtaagcattattgtgcccattcgatca

SEQ ID NO: 14228 - DNA, 429 bp, Saccharomyces cerevisiae
gcatgaaggctatcacggtaacaattccacattgccgagtgattactacgcatatataaacacacacactcaccatatatatgtacgcatagtagcatctattgaatataagaagatagagtttcaagttatacattatattgtactattttcttaaacgatggctcataaattctataggaattatcaacccaataacctcatcgctaattcaaaagtagcaaaagtggcaccattggcgggagcagctcttagcatggtaggaccaaaccctttgaaaaaagcgcctatccctccattggcatataaagtcttggctacactggaaatagaattaccaaatttaggcttttgtaaattatccgtttgcatgacagacttgatgacatctaatggatataccatcaaccataaggcagtgccagacaa

SEQ ID NO: 14229 - DNA, 445 bp, Saccharomyces cerevisiae
atgctttgatctgctgatgtagcaatgtttttttccttctttttcctgacgtattattatttgagaccgaaacttcgctggaaaagaaacacttcgatcctttttttatcttctgcattataacgcgcaacgatgaagtgttaatacatgaaagaagatgggattggattgtagcgaccaaaggccacaaataaatatgcactgtttttaaatttttttttcattaaaaaaatacgaataaattccttaaacacatacatcattttgcttcaaatttttacgtttgtaagaaagaccatttgttgtcttaatacctatgaagcactacttataatcttaattaaatctaattcttttctttaactttttttttgagcatcgcttctatcaattatgtgtatacatacatacatacatataaatatacgcgcaggctaagtagaaa

SEQ ID NO: 14230 - DNA, 457 bp, Saccharomyces cerevisiae
cgcctctagaactactctcgatctatatactttctcacctattggatctgcgacaagtatttattcattcttgacttatttccaggctttttaactttataatgtcattgtgtatacgtataatctgaaaaaatttcgaagactttgaagaagactgtgaaaagagtctgatttttccaatacagtgaaaatgggtttaacaaatatccaaaaaagtactttgaacagatatcgtaaatagacgacttttttatatgaataacaaaaaataaacaacagacaagaggcctcagaaggcttacgtaaagtacgtaaacgatctacctcttacaactggtagttgcttttgctctatgttttcattacgctctcatttctccagccgttgggaaacttttcgataataacgaatgaacagtttcatacatgcctaggaagatagcaccacctgcactga

SEQ ID NO: 14231 - DNA, 469 bp, Saccharomyces cerevisiae
gaaaattgaatatcgtatctgtttatacacacatacatacatttatatttataataagcgttaaaatttcggcagaatatctgtcaaccacacaaaaatcatacaacgaatggtatatgcttcatttctttgtttcgcattagctgcgctatttgactcaaattattattttttactaagacgacgcgtcacagtgttcgagtctgtgtcatttcttttgtaattctcttaaaccacttcataaagttgtgaagttcatagcaaaattcttccgcaaaaagatgaatcttagttctcagcccaccaaaagaggtacatgctaagatcatacagaagttattgtcacttcttaccttgctcttaaatgtacattacaaccgggtattatatcttacatcatcgtataatatgatctttctttatggagaaaatttttttttcactcgaccaaagctcccattgcttctga

SEQ ID NO: 14232 - DNA, 490 bp, Saccharomyces cerevisiae
atcaattaaggaaattatcagtaataattgtacgctattttcgtttttattatctttattttctttttttattcttcaaaggagaaagtactacacgtgttttcagaccaatgtgtgtttaatcaactttttattctatgtataacatataagcaaaaaaagatataatataattaagttttatacggtaaacatcgttaacatcactcaaccggggtgagaaagtaccatcgatggaactgcactttattttgactacatgtaaagttaaaagaggtgttatagaagtcttttaaaaaacgtaaggtaattagaaaacaattgtatattttatgatatatgctaggactgaagtgaacaatgatatgtatgaatgccgtatagggaaatgaatttgcgaataaataatgactagagattagatcaaccacggaaagcgttcggatcaagatccttcaacggttgttgatcgacgatcttgaatccgaat

SEQ ID NO: 14233 - DNA, 488 bp, Saccharomyces cerevisiae
cagaaagaatgaagaaagctataaaaaatttgaattatactcattcagttagttttttattagtaatgtacaagtaaatagcgtataatatataaaggttttacgtttctctcagtatctgggaatgccttattatcgatatacacaagaatttctggaagaaatatttccttgctgcacccatacaattctaaacccaaacatgtttcccgctttgtttttattccacactcggcatattgcgtctatgaaaaagatgcgaagtgtctttgtgaaatgaggaagtgttctcgctagagtccgcctggttccacgccaacctttcagcgggcaagtccaatagctttacgtttcccttctctgctgcgtctgttgaaaatctataatcaataggtaaaatagtgataataacatagctagtacaatttacatagtagcatttgctgaagacttagaggaaacgtatcaagccagggaaaaagatgtcc

SEQ ID NO: 14234 - DNA, 475 bp, Saccharomyces cerevisiae
ggttgaaagatttttgtagtttttgtatatgtagtttttaagtttgaataataattagaaagaagctgtcttttatttatagcatttaataatgggtttgcttgttaaaaatttatcataaatagtatgtatatatatatatatatatatggatatgtatacgtggtaatgaacgtgtatacatatatttaaaagattgcaatatagtttttagaattaacctgaattaatttaaaaatcatatattaaaataaacaattgtgaaggtaaaaagaaagagttaggggaggtcaaacaaagtaaaaaaaaaaaaaaggaaaaaaagcggttcgaaatttatttcattttatacgtttttttgttgtttttcttttttttttttttgaagtatgtttcttctcttagttagtcttcttttgagcattgttttcagctctcttcttcattctttcttctctggaggccttagcttctg

SEQ ID NO: 14235 - DNA, 490 bp, Saccharomyces cerevisiae
aggaaaggccgtttttatttaccaaaaaccaataacaaaagtgaacgcttgataaacaaacatacttagcataaataactacatataaaataggccaaggataaatgaaacgttgactagaatgaatgaaagatgtgaaaacagtacagttaaaactgcaatcccacaaactaaaaataatatgaagaacctgtctcaaatgtataaatgcagaataaataagtagccgaaaaagtctcggtaattttctccctaatgataacccatattttcgaaagactctaaaacctggtgtatgatcgttgagaacaaaattcgtccttgtagtagtgtgtgtctttagaagccattcgggccggtagaaggaaaggtgttgttagtcccagagtgatgtaagcaacataaaacaacgtcgtcagctttttactgggagcacttgccttgtatgatttagaaacttgtgaaaatgatttcatggccagcattgtta

SEQ ID NO: 14236 - DNA, 439 bp, Saccharomyces cerevisiae
gggttaaatatcacttttatatctttatttatgatagaataaataacagaatatatgaactcgtggaaaagtcttattttgctgtgagcacttcttctgtgctaatcaatagacataatgtcaagcgttgagcctttatgtgcttcacactgctcgacaacttcatcaatttttcttgaagcccatggaaatcttgggttgattaagaaaggacgtaagtcaaatctgttgtcttctggtgaatactgttcagcatgataactaggagttaaaacagtttgcttgtgtctgttgatggcatagaagaagaaaaatcttttcaccttttcagatatttgacgaggtgttaactttggggaccattgatgaagaagttttaagaacatagaataaggaccacatttttcaacctttcttaggtaaccaaacacgcccaatt

SEQ ID NO: 14237 - DNA, 416 bp, Saccharomyces cerevisiae
taaaatgcatcagcatacaagatagacaagcgtatgtaagtttactagacggtatacaattatgtaacgtattataagttattcagcgtcgcgttcaggaagtgctttttttaataatttttcccgccgactagtaaaactttgccttcaattagcgtcctttactattaaattttgcttttcttactggctttagaagcagctacctttccctccaatttattccaaagctcatctgcgtcttcttcaagttctgtaaccttccttttttgcttccctttggcagctttcgcacttggacttagtggcatctcgatttcaacgtcatccagcataacaataaaatttatacgggacccaacataaaccttcaccagcattttgttagtttttatatcgaagatccgaacatacct

SEQ ID NO: 14238 - DNA, 434 bp, Saccharomyces cerevisiae
tcttaggggtcagaaatatatacagtgttagtagcatggtacaagtgttacgataaggtattttatagaatgatcatttttttatatgaatattggttcctaaaccatcatcaataatcaaattattacagaacacaccttaattgtgcggcgtattctaaattttacgtgttcacaatatggtgttgttcctatgatttgctaacatatttgggatctgtctatcatttacaccgccaggagcgtggacagcgtatatctattaagtttataaaatataaggcctacatttggagttaggaacgaatatgcaacccaaagcggtgttctttaccacggtaatcaaaaagtttctccaccggatagtatccaatgtgatggtggaaagtgatgatttctttgggattataatagagggtaatctgggctgattt

SEQ ID NO: 14239 - DNA, 453 bp, Saccharomyces cerevisiae
cacagaagaagtgctcacagcaaaataagacttttccacgagttcatatattctgttatttattctatcataaataaagatataaaagtgatatttaacccttatgtattttgcacggttttgtgttgaccccaattagtcttgattactacattcctagaatcgttccgcttccagaaatcaattaaagtgattgctgtttttataggcgaatcttcttgaatgaaatgcccggaatcttggaaaactaccaactgatatttaccttgcatttgccccacaattaattctttatcgagattttcgtttcccgccaatattaataatttactaacaggtaagccaacaaaggagtgcgacagatcggtaaaccatgtgtcccagaaagggctaaaggtcttaaggtttgttatcctgacaactttccctgacttgagcggagcaaataaagct

SEQ ID NO: 14240 - DNA, 431 bp, Saccharomyces cerevisiae
acaactagctttcaacgaacgtgaagattgtgaaactccttacaggctgcatttcgattaattaagtaatgtaaaattaagactattagtacataattagatacgcgtatcttttcaactaaggcataaaaaaaaaaggtagaaagtgaggacgaaaaagtgcaaaatatcaaagtcaaatcttgcgcatattcgagcttacaaagtcattgaagatttattcgccagtgtggtaaaacggcatactgttatcattcttctgttttggtatccttcccctctggtttctccttcgcctcatccaaagactttatatcactcccaggaagatcgctatcagaactacagactctgttaatatttaaaaatttttccttttcggcaagcactgtgttaactaattgtgcaaaagctttgctggttaactcgga

SEQ ID NO: 14241 - DNA, 420 bp, Saccharomyces cerevisiae
tgatcgtcgtgtattgttgcacgcgtcttttgactgatcttcagcctctctttacactgtaaatatttaattttttttgtttttaagttctactcgaacgatcaagtagtcacttagtcgctcctcgttttcctgttacttctttaagaaaaggttacacatgaaaaaaaggttttacaaaaagtatataattgtttattcattcacttttctttctgattgattcaaatgtgatttatttcttttaactaaatacaattaatgctcctcgcaatattaaccagcatgttcgaaaacagcagatttgaacttaccatcagcgaagctatgcttcatctgttcagggattgggaattctacgtaatcatcgtcctcgccgattggtaagttgacgttaatagcagttgagcacgaggtgta

SEQ ID NO: 14242 - DNA, 414 bp, Saccharomyces cerevisiae
ttccaaccattgcttgcctcgttgacgagccttcatctagtatattgtaacacataatttagtatgtactcttaactattattcttattgtcagcatttatacgacgtacagagcgaccgaaaatttcgacaacacgaaacgaaatcgacaatttgccaacttgaataaataacagatccgtcttcgagactgtgacgattgagcctcgattcagtagcatacagggaccacaaacttgtttgaagaggcattgcaattaggtaaatcatagaattggcgaaaccagcaggattttccaaacatttgttacttacccccttctttgcttaagatataaagttttttctttttattttatcttccctttacacttttgaataaaaacattatcatacctgtttacaaattcgcgg

SEQ ID NO: 14243 - DNA, 417 bp, Saccharomyces cerevisiae
gctggagagtactagcgatacaaatatagtgttaagctctttcctgaactagaattctctttgaaataatcactgttaatgtaagtagtaatcaataatggcgtgtaacagtataatattgttgtctgaaataaaaaacaacaaaaagttcgaattagttttattttatttttcttttctaactaagtgaatatccatacgtttgttacgtttatttcagcaatattatagtcttaaatgggcttgacaatacaaaaatcaatgagattattcgcacctgtcatttcccgtagtttttataaagaaatataaaaaaaaatgttgcgaagaacttttactagagcgtaaacgaattaaaaaaaattagtagtgtaaatataatcaccacctgccgtaagcctgcttgagccctttatt

SEQ ID NO: 14244 - DNA, 438 bp, Saccharomyces cerevisiae
aaaccaaactacaaatagcgcctgctccgtcaaaacaggtgctaaaacgtcaacatgtatctatctatatacacataattcaatgtagtagccacctcacttcattctagtgccttcttgggttcaaaaatgggtgcggtgcggccggagatgaagagagaaaagcaaaattgtatctaaaccagcctacaaaaacacaaacttgatattataaagaatcaagcatcttactgaacttttgtcctctacagaaaagcgaaaaaactctaagaatagagaactagagtggtgttcatatttctagtcaccatggcgtttgaggattatttttctttccagatattcttcattttcttaaggaaatccttagaaattgttgtcattgtttctatcctgttgacgatcgtcaaacaagatctgtctgttgaggacgacagc

SEQ ID NO: 14245 - DNA, 458 bp, Saccharomyces cerevisiae
tgaaagcaatcatatgtaaagttagcatttattttgctgtatatagtattatctgcacactttgatttaattcttcttttggaggtatgtaaaattatacgctgtacatttttcagattggacttgttagatgtaaactttagattaaagatgttcgtctgaagaattttagccatgtcatgtacccctttcataaaccaagttatacacaaagattacaccttaccccagttttggaaccttttaaagctagtcttagatacccaaataaatattcttgagttttgcattattcatcatgtggtccaaagcttttgtaccacaattcgagttggcaatccaaaatatctccactgtttttatctgaacacagcaaacctaaattataagattctgaatccgttaatgctgtattatttcctgcactcaaaagagtatcgagttccaccattgtcaaa

SEQ ID NO: 14246 - DNA, 466 bp, Saccharomyces cerevisiae
gatagttttaattagtcgtttgaatacaaattaataatgcgaacgccgcagcgttttatcccgtaatgctcttgctaggttttcaaatatataatagagacaattaagtaaaaaaatgcttggcagctgggcatgctatatacagggatgaatataatacagcttaattttcaatatcaaaactacttccacaaccacaactactttttaggctaccattgatgattttgaacgaagaaccgatcaactcattagtgtatgtcagtgtagtgttattcaaaatgtttagtgatttactatcaattatcactcgacccttatcttcgggtaacacgtatattatatccttggaatcatcatcgtcaaggtcgtctgaaaactccttgtctttgacatcattcttaatatctggcttggtagcgggttctagagttagattgtactggaaaccgtgacatccaccact

SEQ ID NO: 14247 - DNA, 455 bp, Saccharomyces cerevisiae
taaatgtttcgctattttagtctttgtaatgtaacataaatggctctagtatgcaaatcattaaaaaatagcatgtatgttaattaaattatcacggctcattcatttgagttgataacgcaattctgataagcatatcacgtgactgtggttctaagagttactccgatcgccagtaaatactttatgagacgttgcattatttctgtttagttgataaattttgatttctagtctgttgaaagcctaatgcatgcagatgacataaatgtagtctgtttttgcactggtgatttgtaaaccagacaaatatataacatgataaccaaattgtttgttataagatacgcttgtcagattgaaatggagggtgtttcagaaggtgactaaaatatcgaagaaaagtatgccagaaaagttagccatgtcaatggtcgatataaaagatgcgggga

SEQ ID NO: 14248 - DNA, 457 bp, Saccharomyces cerevisiae
gctcagcaagttaataacgcctcatgtatatttttcatatatagcgcaatcaattacaaagcgaagaaaaaaaaccctatgtattctagacatatcacaggcatacgggttttctcacaccaacctttcaagtcttcagcacttatgttttaacttattttctattattcagtatatatatggaattaacactggcaacccaagcatcttagccgagattcgcggagaaaattgaaatcaagaataataaaaattcttgattcacggtcataagaggctgaagcaacagcaaccggctccccaagaactacaatacgcgtccgatatactttcttatcaaatatattggtaataataaaggctgcagttctttttttaatatagtctttttacatttattgcagctaacaaacgcaatttttctttccctttcactcgtgcggttttaccaggattg

SEQ ID NO: 14249 - DNA, 483 bp, Saccharomyces cerevisiae
gtataggttgcttttcaagctcttaaaattgttggatcagctgtgctaaggggaaggcacttttttgtatcatgatcctattttttttgttatttaattatttatgacatacctttatactttagttttcaaaaatccaataatagataggcaaggtttacggaaaagagtggagtgcaaaataaatagaggaaaggcagaaggaagaaggaaagcgaaaagaaaaacgaagatatatttggagaaaagtatagaaataataaaatgaagacacatcgattgaagtatgctcaaatgatgagaaaaagagacctttatctcaggccacaaacaaccattgtccaagtggcttatctttgctatagttttgttcgaatattcggggattctatctttggtttcttcaacaagttgaccccatttaccagttcttttttgctcttcatatactgctgctcttttgaaatgtggcatgccctaaac

SEQ ID NO: 14250 - DNA, 407 bp, Saccharomyces cerevisiae
cagtgatgcttacatctattaatgtcttaatatttaattttgtatcctctgtattatctgtatgaaccacgtgacttaacatgaatggatttgcttccacatctttcacctcttatcatacgttcataacttcttcatccgaagtcagatttgaccctcaaatagataagacgccaagaacaagcgtcaacggaaaggcgaattctacaatcaggacatagcatcaaagagaaaaggaattctaaggtatggaggctacatcaagtgctctttcgtctacggcgaatctcgttaagacaatagttggcgctggtacacttgccattccgtacagttttaaaagcgatggtgttctggtaggggttattcttacattattggcggcggtaacatccggtctgggtctc

SEQ ID NO: 14251 - DNA, 500 bp, Saccharomyces cerevisiae
ttattgctcattcagctttttcaatactatttgaatagagcatgacctgcataaccaggtcagacatgaatatagaggggaagtgatgatctagtggaaatacgactatacaggtatgtacatgttagaataataaatataaggaagaaaaagtggtcaggtgcaagtatacatctttaaccgttttcttttctcatccttttttgagagccaaatcccgtttaattttttctttttcctcctcaaggtctaaaccaaactcctcttgtatctttttctccaacctaagccttttctctaaacgttcttttttcatccttgccagttcagctttaatctcataaggctcttttggtatttggttcaacgttgcaggatctggccaaaaccctggaacatttaattttttatcagtatctgtaccaatatagtacattacagcaacaggtgctagcaaacaaaatgaaaatctaaagatctccagttgcgcccttgtatat

SEQ ID NO: 14252 - DNA, 458 bp, Saccharomyces cerevisiae
tttcatatactcatgatttctaaacagtaattagttttatctgacttatttttttttacgcacctttgcatgtactcttccatgtatatcaatatttgctattctattacttatttctagtaaagttggctctactcagattaggtttcctgtttttgtaatttggtttgtaatgatttttattattatcttcagagctcccaaaaagtacatctttttcttgttgagatagctcatattcaagtaatcctacatctcccaattctcttataaagtccaaaagttgggagttttcgtttgcgaattctcgctgtatcaatttcaagttcaagtcaatcttcggatttcctctctgcacttgattttgaatactctgtataaattgcttttctttccttgactctttgaaaatgctaggttggctcttcagttcatcttcctttatgcccatttcttgc

SEQ ID NO: 14253 - DNA, 499 bp, Saccharomyces cerevisiae
tcctaattagttacttgtaaggctgaaatttgagattaaataacccaatatgaaaacactacattaataagatgtaattatttttatttataaatccatttatttgataaaaaatatgatatcatacaaagtcatctagtaagttcttggtaatagcagatttttttggcttctgtggcttttgtgatgaaagatcatctaatatgtccttagagagtttatctttcctattttctgagttgtctgtttcacccacagagtcgtttggcgcttttggagttaaattctctttatgctgagaatatgaaggagagacgaactcatccagtatacttctaggtgcagaagaagaactttgagcgagggaatttgaagaagtgctatttggtggtggttgcaagaagtcgtctaataagctatttggtaactttggattaggtgactctatatctgaagcacttggcgagccaaacttatcaaaaagactgggcctcatcct

SEQ ID NO: 14254 - DNA, 400 bp, Saccharomyces cerevisiae
gtgtgcgtaatgagttgtaaaattatgtataaacctactttctctcacaagtactatacttttataaaacgaactttattgaaatgaatatcctttttttcccttgttacatgtcgtgactcgtactttgaacctaaattgttctaacatcaaagaacagtgttaattcgcagtcgagaagaaaaatatggtgaacaagactcatctacttcatgagactactttacgcctcctataaagctgtcacactggataaatttattgtaggaccaagttacaaaagaggatgatggaggtttctttacaataaagaagcacatgtgtgttaacgtttttagtatttgcttgttatgtaaatcaggaaaacttcgcgggatttggttggatgctactttccata

SEQ ID NO: 14255 - DNA, 476 bp, Saccharomyces cerevisiae
tcaattcaattcccatttcagttcttctttctcactattttttaatgttcaaaaactcaacggtttgatcatcaaaaaagatcataaataaattgcaaatataaaaacaacagctaacaatcctatcacagtattaatactaatacatgtgatactaagttacgttatcgaaaagatagatcctgtatacctatatatataataaattcttcaacagtaaatatttcattcatgcacttgactttttttcataaataagggcacgtacactaaaaaagctacatttctctcagataatgagtagggcatgcatatccctgtggattcttatctaaatataactggtggtattcttcagcatcgtaaaagttcttgattggttcaataactgtggcaatcttattaccccattttggttgccattcttcctttattttggctaattcttttaaatcagcatctgaatgagcgaacaa

SEQ ID NO: 14256 - DNA, 497 bp, Saccharomyces cerevisiae
tcacttcatttatctgttaactttgagagcttttatttacaggcgctttactatatatatatatgtgcatgcatggacgcgtatatgtcgtttcttgatatataatcacttttagtctaatgactacatgttaagttcttgttcctcccacttcagggcctttgcgtgtgactttttgtttactacatccagtaagatttcaacgctatttctatcctcgatttcttctaatgctttatgcaaattcctaaccatggaataagtccaattgaagcgattttttgaagacaatatgatagctattgcgtccgaatactttccttgctttgtgaagaattcaaccattagatgggcaaatttctgatcctttgctattcttattctttggtccattttcagaaacggtacagtcgtcctaaatttacccctatcattccatactttctttgctaagtcctcattttgaaattctatagcggctttcatcaccagctcat

SEQ ID NO: 14257 - DNA, 491 bp, Saccharomyces cerevisiae
tggcgactttgagttttaaaagattcaacttttctatttgttaattttattcttttttattcattttcatcaagttactacttcgttaaccgcgtccgtctctttttgttgtttttatggagtttttttttttttttagaggcgactctttttctttgctatacatataactgtgatactacaatttttttaaaagcatctacgctgttgttttaccgaccacacacttcagttcagccaagaatcggtactatattacattgaagcaagtttggcgtttaacttatatatatatatatatatatatctatatatacatttcatcattaataaataacattgattatctacaattacaagtgttgtgttttgtaaagccttacctaaattttttttcgatgctattttgataaaaaaacatgactgtaattacttttgggctcttgagcggccccaatattttttgtgtacgtaagcccagccacacattt

SEQ ID NO: 14258 - DNA, 407 bp, Saccharomyces cerevisiae
tatgtattttgtagcagcagcaaccttatttaaagaacacaggtgcatctgcttgtttattacctttcgtgtattttaccagacgaaaagcgtgaagagacgtaagggcaaaataacccagttgaacacaagaaaggaacatctgaccgcatcaaaaaaagagcacattcaccaaacgtaatgtctggaaatagtcaactgccacccgacgtaatcgggtttatatgttctaagtatgatatcattttggccagcacctctccacggaggtatgaaattttacacgatataatgggaatcaccgatttaaaaacaatggtttctacttttgaagagaatcttgataaaatgaattattctaccgatccgattggatatgtgtgcgatactagctggcataaagcgca

SEQ ID NO: 14259 - DNA, 482 bp, Saccharomyces cerevisiae
tatcaaggaggcagaaaaagtaaataaataattacatataccgatatcataaataagaaaaaaagaaatctacacatatatttacgttctcatttctaatcatcttttctactcttgttctgactcttctttttagaattttgattcccggtcttattggcatttctctttgccgcgactttcttttccaattgtaaaatatctctttccgtattatcaaatagtttcttctgtaattcctcgtcatcaaattctttacgagcaaatttcacaattgaacagtctgagatatacttaaccttcgtgtcttttaagtttacttcctccaattccggtgtcattaaagcgtacaagaaactttgatcaccacgacgaccactcttggtaaacagccacaatatggggtacaacagaatacagtaaagtattattaacaataccaccgaaccattactaatgacgcggcgtaggctatttgatct

SEQ ID NO: 14260 - DNA, 444 bp, Saccharomyces cerevisiae
tgttaattttgatgctgatgttgatgtatagtaaacatacatatatgcatatacgcacgtatatatatataagaatatgaaacccaaactgtggatattatttcgtttattatgatctctcgcatatcttgatacgaagtgcaagtcattataatatttagacttttcattacgttaatagagagtcactttaaccacgaggggaaaaaacacatacccctccccttcgaggtaatcttccggtgagatcttccctgtatgcagttcccgggcataggcgggtttaacatcttgctaaagaactatcgcactaaccctctggtacccaatgccgagattcggtaatgggggcacggcactacggaaaaaaaactacaattctaactctaccccgccccttacgaaaacgccctagctcaaccattccgaccgataaaaagttgc

SEQ ID NO: 14261 - DNA, 450 bp, Saccharomyces cerevisiae
acaagcgcgcctctaccttgcagacccatataatataataactaaataagtaaataagacacacgcgagaacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttccttcttctttttcttccacgtcctcttgcataaataaataaaccgttttgaaaccaaactcgcctctctctctcctttttgaaatatttttgggtttgtttgatcctttccttcccaa

SEQ ID NO: 14262 - DNA, 495 bp, Saccharomyces cerevisiae
gtagggcacaggtaaataacctatcgtctatgtactcagtctaatctactttgatttaatttaattcaagttatataaatctattcttttccctttaattttaatattttaatttcaatccttttcttattttctatttttgctttttttttttcttttttccatattctcaggccacgtcaggcttgcataagccacgctagctaataattcagcgagaccctattccaaacctaattgttcggaaccatgccatatctcttccgcagtgtgtggctaagcggctttaagaggatacgaaatgtcaaaaaacgagaaaattcgattatatctgtacgaacttttctttgcgcttactgcctgtttactttgctttgccttctactgtttttttttgctcgaggccgatggtgaactgcaacgttatataaactaaagtgccagaataaaaataaagaaaggcaaagggagactatccgtcttcgaaacaagtca

SEQ ID NO: 14263 - DNA, 435 bp, Saccharomyces cerevisiae
tccaatatatactcacatgtaacaacttattatataaatatttaagggcaaggatatcctacattatatttcatagaaaaccgctcaaaaaggtgtattatctccattacatcccaacaccacacatatttcagcgataaaaaccttaaatgtgaaattcgctttggctctgcttccttaaatgtacgcaattgccgcttttttctgacatcttttttgacgtgtagagaaggaaacagatcctccagaagggatttactgttggctattttgtgttagaagcaggttaataatagattaggttgcgtaagtcatggtcgaaaatagtacgcagaaggccccacatgccggaaatgatgataatagctctaccaagccatattcggaggcgtttttcttagggttcaataacccaacgcctggattagaagctga

SEQ ID NO: 14264 - DNA, 498 bp, Saccharomyces cerevisiae
attggctaaatagaagcatcaaacatatgtatatgcacatctatattaatgatacattattctcttcaaggatccaatatggcttcccatagaattatgaaggaagtccagttctcatgtttccaatcatcacatctatatatttttatataattatatctttaagtattgttcggtaatatgaggacagacgccatcaatgcaaacaaaaagtgaaacccgaaatcaaacgaagtgaataagtagttgtagaggcgacccgatggaaaattttgtaaaaatcgaagactgaatctcaacaacgcaaaacagaataggacgcatagattcatacctattactatggcttgatccgatctatctttatgaaaagatttatgcttctacttcgaatatgctaatactattatcgaaattttttaaagtttttcctcaagggatacatttacttcagtgataccctcgttgatatcctcgctgaccttccgccttttagaa

SEQ ID NO: 14265 - DNA, 462 bp, Saccharomyces cerevisiae
atgacgatttttctgaaatctttgtttacatttcattctatgtgcgctagatataaaaatcttattgtgaaaggtgtttgaatcaatttgaaaaaatgtaggttgaatttggttagatttggcccccgaaatcgataataatggccaaatactaagtacattaattagttaattgttctttcattaataatttgaattccaaataagtccgtgccgaaaactttaatgttttaaaaaaacataaaaaaatcaaaaacccattcataagatactgtgttgatccatatattaataggttttaagtacatatagaatacttaagaaattacattccattgcgatacacctatttgattctgattgtgttgaagtctgtataaaaggcgaaaaaaataaaatgaaaataagaaaataactgcgctacttgtcttctaaattatcttctggtgtctcgtccttttt

SEQ ID NO: 14266 - DNA, 434 bp, Saccharomyces cerevisiae
aagcatcttgccctgtgcttggcccccagtgcagcgaacgttataaaaacgaatactgagtatatatctatgtaaaacaaccatatcatttcttgttctgaactttgtttacctaactagttttaaatttccctttttcgtgcatgcgggtgttcttatttattagcatactacatttgaaatatcaaatttccttagtagaaaagtgagagaaggtgcactgacacaaaaaataaaatgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaa

SEQ ID NO: 14267 - DNA, 425 bp, Saccharomyces cerevisiae
tttaaagattgtccatattcctcgatccacactttcaagtttgagatttattgttggcaactttcttacatttttgttgtttcaacttctattttatattctaacagccgcttccatttatttttcataggctttatataaaaaacaaaaaataatggaatcaaccaacccttataaacttatatgtagtttacatttaatcaaggtctgttatcgtggctattgctctaattcattatttgtcgacatgtattggttgataatttttgttttggttcacgcgtaagaattttttttcttgtagttgccacgtgaaacctgacaacttatagtctttaagggaagaaagaaagccattctttgaagtgattttactgctttcaagagtgagaaactcctacatcaacgcctaaggaaactcgtca

SEQ ID NO: 14268 - DNA, 416 bp, Saccharomyces cerevisiae
cgtaaatgagctgtcttgtgatagatattttaaataagatttgaagaattaaatgtccacttttctatataatgtgcgaaatgtataatatatgcataagaaaacaaagaaatcagtattttcttctttgtctttgtaatggtgttatggtcctaaataatcagtaaagtcaatttcactaccagcagctgcagttggatccatagtatttcccagccacattgcttgatcagtgatttccttccaaagtttttcatcggaatgatcaatattgcctaaatcctccaacaattgttgtaaatcgtcatcatttagattatgaacggaatccaactgatccatgtttttttccatcacctgagagcccttttcagttagcgtggtttggtatgaattttccaagctcgcagttatga

SEQ ID NO: 14269 - DNA, 426 bp, Saccharomyces cerevisiae
gaagagaactaaccttgatgaagaattattactacctacgactttatctatatgtgccttttttctttctctgcctggtttagttttatttactacgtttacttgtatatatttgtaaactaatgaaaatataaagaaataaatctcaaaacatgcttttatactgtaaaaactggtgttatatgggttaatgaaaggcatataatatacaagggtgacaaatttttagtactttcgtatacattttaaagaagacacttttgtttcttgaggactggtcaattccatttttatttttttgtaaacaatgacggcgagtttcattaggaacgtgagcagaaaaatattatctgttgtaaacaatcgcatcggtgggagagcataaacttctactgaagatatacggtttgaaaagacaataacgca

SEQ ID NO: 14270 - DNA, 406 bp, Saccharomyces cerevisiae
ggggaataaagccaaaatgtttatatgtattagaaaactctgtagaaaattttaatgctgattgtccggacacgacaaacagcgaaataaatactagcagttagtacatcatcgcaaaaatgatgaagaatgtataagtaaatgaaaaaggaaaagaaagcagaaaaatcgagctagtaaaacttgaccctcctcgtcaaagataacatgaatgaagatctattctacgatagattacatcagcggtgccctggaaaatacttgctagaagagttggaaacaagcaaatctaacgatgtcctgcatgcatcgagatttgtttgtgagatggaacttgtgcaaaagacgaatgcatattattgcaaaaccatagtcaagatgctcttagaccacgaatggattttcg

SEQ ID NO: 14271 - DNA, 499 bp, Saccharomyces cerevisiae
gctaagaaataaactttaagaaaatgttacttttcttatgtacctaattaactgttttatataaagcacgaataaaaataattcatatcacaagaaaactttcatggctctagcgctctatgaataatgctttttgtaatgttgtcgagctactatttcttcattaatcatcgtcatccatagccatgggaatttagtagtcaatcgcctgtccaactgtagacgacgtaactctgctataaaaaagacctgttcatattttattttttttttttcatgtgccacgaacaatttaatgtatgggaatacaactgcaaaagaaaaaatcaaaaaaagaaatcacacaccacaaacaccaaacattatgccagaagctttcgccaaatcctgcgtcgattaatttaatgtgaacaccacctcagatctaacactgatgaaaagccttacaaatctcaacacatcttttcctttatgaagaagagtgccttgcacaaccata

SEQ ID NO: 14272 - DNA, 459 bp, Saccharomyces cerevisiae
ggccgaatttttggtatttatctagtatattctaatataaaatgtacgagcatcattaacttcaagaacattacgaagcccgcaattaagtgtcagtccatctgggtgtaaaagttatgtacgctcgaaacaaattttatgtagtttactttagatgcaaatgctattatatattttgctttatgatcctcggcttgatgctcgccaacgtgagatagctggtcatcacaatagatcagccgggacgcttttcgatcacatcgaatcccttcgggacgttgcaacaatacgtgaaaaatgcctcaaaaataataaatacaatggtgaacaacgttaaaaaagcataaaacagctggctattttgatcaggataacatctataagtgccatattaaggcaagatatcaattgaccatgcaaacaccttcagaaaataccgacgtaaagatggatactctc

SEQ ID NO: 14273 - DNA, 499 bp, Saccharomyces cerevisiae
gcttaaggtgggacaaccgcgttatgaaataaaagacgcatccttgtgagtcccgcgcaagaaaacatatgcacgcagaaagagacttttatttagatttagtatatctctaaacttaattcagaagtgaaccactctctcacatccgatgacagtggggtcaataagatgtactaagtaagaaaactaattacacaataaaaagaaacaagctgaaactaggcgtgttaactctttcctaaacgaggaggtttatgtcgtcatttggacatcgagcatttttcagctgttgtcctttactagaaggagaaactttgcattcaataaaattgcgcaaagaggcaacataccaaactcaatccgggtggccggttcgatggccgattcggtatccgcgcgcacttcccctagaatcccacgtgcacccataccatatgatcgttaaattaccgcacccacgcacccaaccgcggctgtttctatggctgtcgttgcattg

SEQ ID NO: 14274 - DNA, 463 bp, Saccharomyces cerevisiae
taccacaataaaggaaataaaggaagacaaaaataataaatatttcaactgtacatatgtattttcgcagcaaacagaaagcatagtttatagtacctaatgataacctttctttcattacttcgaaatctatgacgattatattatacactaaaatatagaaattattttctttatttttaccattttaaacatgaccaataactagaagatacataaaagaacaaatgaactttatacatattcttagttagcagtcataacttgccaaactctaatgacgttgtcggtgtaaccggcaaacaaagtttgaccgtcagcagaccaagccaaagaaacagcatgtggttcagcggccttgctgtaaccagcaaattctggtctcaagtcatcgaccaagtattgtgggtccaaagaaaagaccttaataccggtagcagtggcagcagccaaccagtatctg

SEQ ID NO: 14275 - DNA, 451 bp, Saccharomyces cerevisiae
taaatagaagcaaatgacatcagaatatatatagcgcatattgccaaatatgcttttcaagtattaaattaatgtaattgaactaaaccgatgcttgtacataataacttatcattaaagtaccaggattctaccggttagctgcatgtgatcaaaatttccatacccatattggggaatgcctactataaggtgattttggggacccaaaatcatgctattaccaaaatttgacacacccttgctacttttgtcaggatttatgagcatgagatgccttaaattattaatcaaaagggttttgcgcttcggatcgtttcccgcctttaatagctcatccatactaattttccatatacttcctcttgcatcgaaactgcctggggaggaaacgtacaatttcttttcttcgtcattaaacagcaaagatgaaccaaactcatccgggatt

SEQ ID NO: 14276 - DNA, 440 bp, Saccharomyces cerevisiae
tatacgatctcatcaagtcatttgccaaggaattcttatttcttgcgtaaaatgcattcttttacgctattatttatattgatataactcaaaataaaaaatttatggttatttattctagcggacctttatatcttacttttcttatcataaaactatgtcgaagcctgctgcacaagagaaaattgactagttcagggcaagaacgtatcacaggaagtacgagttgagaaatctggaccgaaatggtccgtggtcgcctacccgccttctgtgccatcacggtactctcttctatgttctcccattagcgctagttacactcctcagcagctgacacatctcacgatcctatcttttatttattatgagaagaacggaaaagatgggatattataggctcagcttactcttcaagcaactactgttgaaccgggtcg

SEQ ID NO: 14277 - DNA, 486 bp, Saccharomyces cerevisiae
aaatttttaggataaagctaagttccatgtatgaaggacgtgtatacatagttcagtaaagccatcaaataagtactcttgtcaactcattctatggtgtgatagttaattgcttacttgtatcgctattaacgactttttttttcttttggcggaagcttcaagacaaaaatgcgatttgagctgactcgaacacttattaaaccagacggaaaagcacgactcatacatatcataggcagtttttactagggctccgaatactttgaataataaggttgattaagtttgtgtgcttcatccaattagctttcagttttccttatttaagcttctgatttcggaatcaaaagttgagcaacgttatagcttgctttttcggaggagaacgctgttgttcacatttcaacaccagaaattgctgatttttactcctacttagtatacatttcactaaacaatacgttttaccatggcattttcacg

SEQ ID NO: 14278 - DNA, 445 bp, Saccharomyces cerevisiae
actaaaggaaagctcggtaataaaaagaagaaaagctttttttaaagaaaacggtaatcaacattcacatacacacacagtacatatgtaccaatatatttatatatgtacataattattataatacaaaatttgtttaaaattcgaccttttgtggagaagagctgttaaaatgatgttggacggacccacctaaaccattgttcatattttggttgttgctattgatactgttgatactgttgttaatgttactgctgttgctgttgttgtattgacggttttgagagtatggacggcggttgctgttgccgttattattatttcttctgttgtagttacctctattgttgtttgaatccctattgttgtagtatcttttatgcccagggccgttactattagagttattgttggagttaatttgctgcttgaccttgtcaat

SEQ ID NO: 14279 - DNA, 413 bp, Saccharomyces cerevisiae
ccttctgcaggctcgatattttataagtgtgagagagttagaatatcttcgtttatctacatatataaagggaagggtttggaatattttaccgataagtactcctctagagaaacaaaaagggggttattaaacttcattcttctttaaacttttcagcgacttctaaaacctcctttttggcgtcatttacactaacttctggtgatatcttaactcttttgaattttaacttcccatcaacaaaaatgaaatgcgatctaatagaaccagaaagtggcgtttttttggctcctagcaacccaataaactctctctttggatcgcttagtaaatgatatggcaaattttgtttactctgaaactttttctgggatgtcacagaatctgcactcagtccaaagacagcagca

SEQ ID NO: 14280 - DNA, 441 bp, Saccharomyces cerevisiae
ttttgtataactaaataatattggaaactaaatacgaatacccaaattttttatctaaattttgccgaaagattaaaatctgcagagatatccgaaacaggtaaatggatgtttcaatccctgtagtcagtcaggaacccatattatattacagtattagtcgccgcttaggcacgcctttaattagcaaaatcaaaccttaagtgcatatgccgtataagggaaactcaaagaactggcatcgcaaaaatgaaaaaaaggaagagtgaaaaaaaaaaaattcaaaagaaatttactaaataataccagtttgggaaatagtaaacagctttgagtagtcctatgcaacatatataagtgcttaaatttgctggatggaagtcaattatgccttgattatcataaaaaaaatactacagtaaagaaagggccattccaaat

SEQ ID NO: 14281 - DNA, 476 bp, Saccharomyces cerevisiae
atagtgccccagaatgtctactcttcaataatcagaaggaccccgtcttgtctaatagaatgggtgaactttttttatttcttggctcatgattatattgtaaaatacatagcattttatataattgtggtgctaaccctaagtacttttttttttcgccctttccgggtttctttttttcaccttttcgtttttctagaatttcgcaaagtatataagagaccataaacagttggagaaaaatatcacaaatttatcagcccaatttatggcagcttaaaaatgtctaggtcgatgctttcaacgatatctttatcaggtgattcttacgcgccaggtggatagaggaaatttgcgacagtaggtttactgtcctggtttccttgtacacttgtgatactcattttttgtctgccaataatatagtcctgtttatttgttatatgatgataaccttctcagctcactcagatctt

SEQ ID NO: 14282 - DNA, 456 bp, Saccharomyces cerevisiae
acttattgatgcaactggagtatatttctatatattctgttcatttcccctctcataatatatacttgtttcgttaaaattttatacgtgtaaataaagtgccataaatttttcagctttacttttggtagagtcctgctagcactagattttacaatttcatgtgcacacaccaaggacgtgttcttatgtatatgtaaaagatatcaaggcgtttttgaatgcgtttttgttgatttgtttactttccggcgtattcctacgaaaaaagcaaagaaaaatacaaaaaaacgaaacattcgcaaatgatgacaacttgaaaccgccaaaagtcatcgcttgggaattttgaggcaagaggctgcttctataaaagttttctttacatggcaaaagggtattcgtattaggatagtattggttatgaacgatatggcaaaacctctcccaactcca

SEQ ID NO: 14283 - DNA, 479 bp, Saccharomyces cerevisiae
tcaatcttgtatctagatgtttttgctatatttatattttctgggccaaatcactaacgctttgaaatttcaaaagccaacaacggatttcggacttcatttatgtaaatgaaaaagaatgtgaacaaaaattgaaaaaattccatattaatgcaccttctaaacctatttgttgaaattgtatttaattcatataatcatattctattcaaaaagaataacagatagtattagcactatttcacgtactgcttctaatactattatcacaaaatagacatcggaaaactcaaaaataacgacaactgcaggactcgaacctgcgcgggcaaagcccaaaagatttctaatctttcgccttaaccactcggccaagttgccaatgtatacattgctgtttcctggtttgaagaagctaatcgtgcacgtaaacaacaatctatactacaagtaaaaaaatggggaaaaagatgctgaag

SEQ ID NO: 14284 - DNA, 484 bp, Saccharomyces cerevisiae
cgtgcactaaagttgacttttctttatttggtttagttccctactatatatcatcatagaaattttcaacatgattttcttgaaagagaaacgaaaggaaaaaagcaatctcgcgagtggatggcatcggattttatgtatgtgtgtatgtatgtttattattcccgcatgtttacgcccttaagcccaattaataatttgaactgacaagcataatcatttgactttcattttttttactatttttttctatttacaatgtaactgttaaattgaacgacccataagttcggtatcctagctgtgtctttttctttttttttttgctcaattgaagataaaagagtaccatttttttgacctacgctcccgttcttcctttggcacatacgcctgaatttgttcacgaatcttttcgagaccagattgctcatcgtagtttcttcccaacgcatcgataaactgtccttcagggtcgatcaaa

SEQ ID NO: 14285 - DNA, 434 bp, Saccharomyces cerevisiae
tgatttgccgtccggaattgcttcgttctttctttcatctttctctttacaatttccaattttcccctacaggaattaattggagggtacaagcgagtagaaatgtgacatatgacttacctatctgtgttttagtatagtttttttttctgtagtataattcacttttacactaattttttcgcctttttctcttaaagagctaatttctataaccttcagcggttataccaaatataaaaaatggaaggaaaacaaacagtaagaaataagcgcaacagcacgttagttcaccattggattccaacatttcaaaatttaatctaatggcaagagatatcacatttttgaccgtatttttagaaagttgtggcgctgtaaataatgatgaggcaggaaaattgttatctgcttggacttcaaccgtacgcatt

SEQ ID NO: 14286 - DNA, 497 bp, Saccharomyces cerevisiae
gaaagctgaattgatactacgaaaaatttttttttgtttctctttctatctttattacataaaacttcatacacagttaagattaaaaacaactaataaataatgcctatcgcaaattagcttatgaagtccatggtaaattcgtgtttcctggcaataatagatcgtcaatttgttgctttgtggtagttttattttcaaataattggaatactagggatttgattttaagatctttattcaaattttttgcgcttaacaaacagcagccagtcccacccaagtctgtttcaaatgtctcgtaactaaaatcatcttgcaatttctttttgaagctgtcaatttgctcttgagtaatgtctcttcgtaacaaagtcaaagagcaaccgccgccaccagcaccggtaagttttgtggagccaattctcaaatcatcgctcagatttttaataagttctaatccaggatgagaaacaccgattgagacaagcagtcca

SEQ ID NO: 14287 - DNA, 487 bp, Saccharomyces cerevisiae
ccacctcatagaaagacaaataaagaactaatcaacgaatgagaaaacatctttaatggatggtaaacatatatatatacagatgtacactttttatttttattgcgataggtgtgaaaatgaacgtgacttgaaactttgcgcgcaaacaaatcatattatgaattactaaacacgtccagtttatctacatttcttttcttctttaatccgatataataggtctcctttgattcgtctctagaagcgtcaggcttgaacttatgaacgttagtgaaaactgcctgcattctttttttaaataggttttcttcttcgccggtgtatagtttacaaacaaacgaacctaatggccgtaataaatctatagccgtaactaaggctgcgtcacataaatcaatagattggtaatggtctcttatactgacaccagatgtattagccatcctaaaataagcttgattagtaatgttgttccaaaaaccgg

SEQ ID NO: 14288 - DNA, 459 bp, Saccharomyces cerevisiae
tttggattctagattaatgtattttaagattttataggataataactaaaacaagctatatgaaatagtttcgtacaatctgtgcttatactcgtgaaaatggcaaatttctctttttttttttataagtagttatgtatgtattttactaattttaatataatcgttctcagtcccaataatgttttattgtcatattatactaaagttgaaatggtggagtcgaccctaagaatttatttcttccagacagaggaggtgtgtagtcactttggttccactaatagacaaccgacattaaaatacttctgatctgtgccttcagaaagcttcatctgtaaccgcttgtctgtatgagtcgtttcaaatggtaaccacttaaacaatgcgaatactacaatgatatttataaaatatagacgtaattatgagggaaaaaacttgtccaaaggaaggggt

SEQ ID NO: 14289 - DNA, 431 bp, Saccharomyces cerevisiae
tattcagttttacttaagtgggaggtttttccccctttttcttatttgtccatattttatgtaaatgtatacattgcattaaattaaaaagaaaaaaaaaatcaataaaacactcaataaaatttcagtttctctgggccaccaacagcgcagttctgtttcccatcttcatcttcatcgtcactcaacgcaacaaaatcttttaagtacgcgtacgaagcatctttagttaacagcatatttgtcatattaccgatagatccctctccagtatatttgtattttctactgtcgttgtttttcaaaggaacagtattacgctctggcgtcaatgctttagttctcctacttagatcagcaaagtcaattttgctaggggaaacccaaatgggctcgtctttttgtttctttcgaaggaacccctctttctc

SEQ ID NO: 14290 - DNA, 429 bp, Saccharomyces cerevisiae
taaactagaatgtttttatttccttccatccatatgttatattaatatgtttccgtatttttgtttttgtgtcccatgcatggaagaatacaacctacaagcagacttatataaatatacaatactacctatccctcaactccatcactaattctaacagcggaccaaaatcagccggtcttagtagttcgaactcttgtgcaaaaagacaaaaatgtctaaaacttgtgtttagtacggtttgtaaatttagttcaagaatttcattaaaatgatgacagtaaatatgcgcataaactctgaataatcgccttagaattggttgaattactcgttggatgaatccctccgggaaggtaccggtgactttggaaggaaaaagagattcgtcatcaaattggtcttgacaccacctcatcaaacattcca

SEQ ID NO: 14291 - DNA, 434 bp, Saccharomyces cerevisiae
agttttttgttttacagtatatgtttccatgaaaaggttgtccttgatacgtggattcatcaagtgagatatatatatatatgttcatatttgtgttggcaagaccaacaactgtatagtaggtaacaaattgtttcattttcttttcgttctctgcccttttctagtttgagagggcattcccatgtcgatatctctagatatcagttaaacattcaaaagtacaaattcagttacggaaataatatataaattatattcgctaaataaaatctctccctttctagggtgttttcaaataatttcaagcttttcccgtagcttcgtcctctcatcttcccaaccttttactctttctagttttctctccaattcctcaatctcgttgtcaatcgacgtgattgcttcatcggtaccaactgcctgtaattgcc

SEQ ID NO: 14292 - DNA, 495 bp, Saccharomyces cerevisiae
aacagaaggtagtagtgcattagaggtattacatatcacgtgatgtttatttctttttacctatatatggattgaatattagagttaccctacgttcaatttctagattctatggtgttacccctgatgagttctgcatctgtcctatctacctattttaccgttttggacgaatattaaagggcgggtaacacaaatactgtctgcgtaatcaatctttttaggactaattaagggtagttccatagttattagaatcgtatttctcgaattgaatttccttccctatgataaacttctacactggaaggtcatcattattttttgttaagtactttacgaatgagaaggtagtttatcagcttatatttcaggtccgttgactttttctggctacagttgttttcaactggtgctgctgcaggatataggaagtcgaagatttatttttttgcacagcttaatgttcctggcgaaaaagcagcgaaatcgaga

SEQ ID NO: 14293 - DNA, 462 bp, Saccharomyces cerevisiae
agacaaacgcctttacgaatgaaattccataaaacttaaaaaaacaaaaaaaaaaaagcttttttttttgatagtataaatagttgattatattaatgtataccagtattataaaacctacttgattattcatgccgttcttatcagaagtatttactgtagtggtaaaatatagtgccttgataatccaatagtcttgtctgtctaaaaggcttcagttgaataccttctttcgtacatgttgctatttcagggtatcgggccggagcatttaccatttgcggcgtaaatgctaaagttaataaatctgagtcttcctgttttatgagtcagatggaggtgtaacgcaaagagtaagttaatcacagaaaaaggttagtatccattacatatttatgttatagaacatatatgcgtatagagacagaaaaattgtttaataataaaatcacccacgcttgc

SEQ ID NO: 14294 - DNA, 450 bp, Saccharomyces cerevisiae
tccatttaagaagttaaaataaaacgaaaaataatgcataggagttctttttgtttattttgctcttaataaaaaagtgtcattgtataattagtcttagtttaattatttatgtttttacaaggacaaaagatttgctgttaaaaagagttttaaatacccttttttcttacatatgtatatatacaggtttatgctaataatattgtatagtttatcatgataatcgcctttcaatttttcttgtcttctatcaaccatttccaaatcatatctctgttctgcttgttcttaatatcattctccatgttaaatttcttcacctttgaaaaacctttattaatcttattattcgacaggttagccttattagtgtagctgctgccataaagtagcactcccaaccgctgcttggttgatttccaccacttccgccttcgctttagttta

SEQ ID NO: 14295 - DNA, 412 bp, Saccharomyces cerevisiae
gctcgacaaatatagaaattaaaagaattcttttagataccaagattgacatttatatgcattgtatatttttgacttaaaaaattactccggcttggcatttattcattaacggcgggtttgattatattaggctttgtgcgatataatatgtattacccgaagggagggctattgcactttcttttcctttccgttttaagggccctttttcatttcgatgtttgatggacacacatgaagtgaaatgtggcaaatagaacatctagaaaaactagggcattaggtaaagtaccccagcagaacttcactttacaacgcaattgattcatatcactgctcttttatattgtcctttttctcttttagagcttttcatccgcatcttctaacttctgtgcacccctttcat

SEQ ID NO: 14296 - DNA, 413 bp, Saccharomyces cerevisiae
aaatttatgtagctattttactggtgcagcgtgcatctacttccttttttattgttattttcatttatacataatacaaaaaaaaaaaagaagaaaattaatgatcaataaagaaaatcgtgaaattacagcagaggttttgtacctgctttcctacgttagtacataatatcttattttttattagtgcatgtttttctcagtgtgtgtttttgtaatttgtatatactacacaaagaatcggaagggtaaaatgtgaaaaatactgggtcttttgaaatatattgaacgggctaatatatgaaatgaatatgaaaagaagaaaaaaatgtgacaagaaaaaagtggtgacaaaaaagacaaaataattattcagagatgataaacttaaagcaaaacttggtaacaaactt

SEQ ID NO: 14297 - DNA, 479 bp, Saccharomyces cerevisiae
accctcctgcatagtctaacctatagtatttagaacttgtatacatctattctctacactaatatacttatttctttgttcaaatcatcggtaatattacaataaaagaaaaatatgcatatactttcgtgcattgaaggtgtcaaatgaaatcccgcttatagtgaacaggcttccatcatatatacatatatatatatgtttatatatgtatatcatcacttatgctgctccaggagatgtaggtatctattctttcttaacggatccgcatctattaattggaccaaatattgttccgagcttctttccgttagagcttccttttcttccagaatatcttcgagaactaataaaattttcaagcaccaaatattttgcttcccggaaaattcaatttcgtcattatttattaacagaatgttttctctcaagtctttcaacattttaaggtactcttgttcgtccagagttttaca

SEQ ID NO: 14298 - DNA, 419 bp, Saccharomyces cerevisiae
taattcttcatttagaaaaatttcagctgcttttttttttctttttctttccttaggcgtctcgaggttacaagtcggagtccctcttcactatcgtttgtccactttttttatatccccattattttcaatctgaatttcattttttttttttaattcatgaaatttatatgtcccacgtattactacatatttgcgtttttaattaaataaataactgttacttttattatatcttatttgcagatcacttatctgatcaaatgttttcgttttcgtgtgtggtgacgatgtattaggtacgcgaaataaacaaaacaaacaaacaaggccgcaacaataacatcatctaaagacttcctttgtgacccgcttctcaacagcgggtgtagaacttatggtatggccagaaagtaacg

SEQ ID NO: 14299 - DNA, 426 bp, Saccharomyces cerevisiae
aaccatcttaacttctgctaacatatcttactcttttagctgagcatcaaattaattttagtattgcacgttctgttattcttgtataagtacatagaaataatagcagtagaaaaaatagaagtaattttacctttacagtacatatgtgttagtataaggaaccttttacgtgggatactttgcttacgaagaaaaggctgaaaaaaaaaaaaaaagaaactccccccgcgtttagaatggtgcagccgagctacctacgcaggggataaaaagaacgaaagccacatcgactacaagccagagtataaatggtttcaattctcgtagagaactcacaattatataatattggaagacaccagaaaaaataacgagtcaattactatggacgacaaagtttcagaaaaggagagctccccaaaa

SEQ ID NO: 14300 - DNA, 419 bp, Saccharomyces cerevisiae
acactcctacaagtgttgggaaaaggagtcattcttttctattgtgtattttactcttcttcaatatttagttaattcttgtcttttattctctttctccgtcaacattagtatttaattgtatacagacaccattcataattgcagttagcttctctgttctttctcattcctaggatttacaatgcagtcttaccttatttgtttatgtttttttcgtttatcaagcgtgcaatcaattactgaagattcacgtgccaaaacgtaaaaataataataacataacccgagagaggcaagattagaatcaattcatcttttcaaacaaatggttatatcgactaagcgaagtgattagatggtgtacgtcgcagatattcaacagtgacgaattatatgcgattgtaagattgattggc

SEQ ID NO: 14301 - DNA, 489 bp, Saccharomyces cerevisiae
acgctcgcatagtctaaaattcatatagactaaactgtatatatgccaccgtatatataatacacgcacacacaccaacacaaagcatgtcacgtcatgtagctgatcacgcagcacgaccgcggcccatgcttatctgccgtctttttgcccctttcgatatcccacgccccacgcccccacgttgttgaggtgttttttcacctcggatccgcccgacaatatctgggattaaaagtgctcgagttttgctctctatttcacaatcggtgatagttgagcttcctttcactgcatctctttgcagcctcgggggatgaggctatatacttagagggcctgaatatatgtttgacgcatccctccttcgtacgctaccatctgttactcttgcaccgttattatatgcttgtaatttttgttatataataggcctttcattgtttttaatatagactttcatcatagggcatccggaatttcttctca

SEQ ID NO: 14302 - DNA, 483 bp, Saccharomyces cerevisiae
taaaacgatacgctaacctataacatataatgtataaatgataattaaatacgtacccgggtagtagacatcgctattatcatcacaatccacgaatcgcgacgcgaattcgcgaaaagacaacaacaataaaggaaaaaaaaaacaaagaaatttttcgacgatttccatagagaaggaaaacaacgaatagacaaaaaaatttggggatccaaggcatattctgttacattgtacctgtaggatttactgagagctgaaaccattgaaaactattctgcaattaattatcttcgtacggactatcactacttttttttaagaaagacttatttctattgtttattgtttataattcactctgaatactcgcttattaattgtgtgataaattctaaaggatgactgaaggaaagaggctgcaacagatggagcttcctcaaatgaaatccatttggattgacgaggatcaggaaatggaaa

SEQ ID NO: 14303 - DNA, 439 bp, Saccharomyces cerevisiae
tatcggtgtctacaaaatgatacgctttgtttcatattaaatattattttactgtatgtcgcccagaataatgatttttttagcacaaaaacattccaaaatataaaaagaaaatgattttatatgatagatgtacttcaaggaaatcgacaattaaaagaatcattcttcgtaatgaatatatgagcatatgtctataaatcaacagtaaatatacaaactctttatccttttcttggttttaggtatttaccgatgttttgagatgatatcagccaaatctcaaaccttccctgtcaagcacttgcctgtcaaattggatcaaataaacggttcgttgactatgtccgccttggggcattcgatgtgctgtcacgccacatggaaatccagcattgaaaaggaatcctttgataatgccgcaaacgaagtactcaca

SEQ ID NO: 14304 - DNA, 486 bp, Saccharomyces cerevisiae
acgccctattcttctagtccgctgaaagattatatcacttaaagattcttgtacataggaagtatacttattatcgcctttcgtttatctgtatttgttaaaaaatatgctccaacttgtgtagtgaaagagatttttttgctaaaaccattattgctggatgcaaaggacgccatgaagaaaaacttacttagtgagccgctttttggcttattaataattcttcttctcaaactgcaattgcatttccctattattctagttaatagtacgttaaatcatcaaaaaaaatactgaaggatgcgaggttcgaactcgcgcggacaaccgtccaacagatcttaagtctgccgccttagaccactcggccaaccctccacgaattttctaaacctttccggtaaccagttaaataccctattttacccgaatcctcagagtctgtgaataatttaataatctttgagattccattgttggtaaggg

SEQ ID NO: 14305 - DNA, 431 bp, Saccharomyces cerevisiae
aagaacgtttacacacacacacacacacacacacacatatatatatatatatatatatatatatatatatatatattttgcattatatgtgtatgatcaaatctatcgagttaaatatttctacatatttcagtaataaatccatttccattagctattttgcaatgttttttcttttttttttttgctgctgttaccttcgccgctaaaaaatcatttaaaacaagaaaagagtacattgtttgatgaaacaacaagcaagaaatgtaaacgatagtcaaacttagtaagaagagaatcagctggcttggtacttgatcttttgatttgacctcattctttttgcatacacggctcgtttggaatactgttgtaaaaatgaattacatggcttatgattatgatccccaacattcgttggaaacgtcctt

SEQ ID NO: 14306 - DNA, 424 bp, Saccharomyces cerevisiae
tcaattgaatttgaaacgaggctctgagttttatctccctcatgatttagttcgtcccaaacaggtgcttctagattatcctcgtagtccatggcttgttattgcaggatgtatgaaagtttataaaatccctgctgcaaattaagagatatatggtttcgttcactacgtagttatagtaaataacctttgcttaacccatttttcaaagcatttttaaaatttactgttatcacttagttgttcttagcggacaacttccgaaaagtgaaatttcatttttcaaaacgacaatagtggtatagaattatagaataacatacgttaaaaatagctgaagttcattacagttctgtagtggtcagcaaggcatttgacgtctattggatagcctacgatgaaaggtgatcgttcgaggcaaaat

SEQ ID NO: 14307 - DNA, 468 bp, Saccharomyces cerevisiae
tcatagtacaaaagaaacgatgcctttttgtccgttatccctttgttttatttacaataagtacgtaaaaacaattatttcttatttttgtttataatgttacaaatcttttttatccccattcttcccaatttttttttcttttctttttttccttaattagggcatgaagcccatttcgattgttaatcactgtcactgtcgctactatcactactgtcttcttcagaatcggaataattattattatttatgatttcatccttttccaaaaatttcaaggttttctttttcttgttagttggcgcagtcgagtagttgccacttagttttcttttgctattgttgttattttttttctcaaaatatctctcataaattcttgcaatagtcgcttcatctaaaatatccaaatcaatttcaatttcatcttcattggaagttagtatttcatctgcgggtaatgaa

SEQ ID NO: 14308 - DNA, 426 bp, Saccharomyces cerevisiae
caataaacgtgtgggagtattgcaaaaacatagtatataagcgtaaatcactatataaagcccaaagaagttagcactaaagcatcattcatcgttcaaaactcctctctcaagtgagagaattcggcgctgaaaaaaagctttgtcaaaaccaagaaaaaaacgtaggattggacacgaggttctttttttaatgtaaacaagaagtggcactatagctgtgaaacttccaatacaattgtataccaaataagctattacaaattgatttaaaatgggtgtcgcagatttgatcaagaaattcgaaagcatctcaaaggaagaaggcgatgctaccgttgatacaaacagttcatcaaagcctctcaaatcaaacgatgaaaccaaagaattgcatcaacaagagtctactgctgttccgcaaga

SEQ ID NO: 14309 - DNA, 492 bp, Saccharomyces cerevisiae
atttaataacatcctttcacacactcacacactcacacactttatatacatatatttttataactattactgctgatttatttgtaaggaaacgtgctttcctcttcatcggtcaagtgataagtttctataatataatagcttttctgtctactatcattcttttttcatttcaagtacccttaatttgttttacccggaccacgacattttctcactacggcacttgagagctataactcaatgaacatgttgcttggagttatttgattgctctgcgtatcttaaaatagcggtctcgaatcaaccgtatgcaacatggtccttttgaaatggctcgtatgccaattggtcttctttaccgctttttcgcatgcgtttaccgactatctattaaagaagtgtgcgcaatctgggttttgccatagaaacagggtttatgcagaaaatattgccaaatctcatcactgctattacaaagtggacgccgag

SEQ ID NO: 14310 - DNA, 488 bp, Saccharomyces cerevisiae
tagtgcctactgtgtgcaaagatatgtattcgctcgttcagtgtttttttaaaaatatgtatagaatttgtcattatctgcgttaaaaaatagttataaagtatatacaataacaataaatgataaagaaatatgcagtgaaaagaaaaaattatgaagcttttcctttcagtgttttctacccttcttcttgctcactacttggaattcccagccgtcgtcatcattgcctgatagagctagcgcttcattccaacttagtggatcatcaccttgtttttcgcacgcaacacgtcttttaataaattcagtggcaaatcttctaccatccataacgtcactattggcataaattgtttcttgaatcaattctttagattctggccccgtaggtaaactcaataatagttctaagacattgttattggttattccagaatttaatttcatctgtgatttacaccatttgataaattcttgccggggag

SEQ ID NO: 14311 - DNA, 425 bp, Saccharomyces cerevisiae
aaataacaaagttttggtgagcacaacggtgtttcattcaagaatgataaggacaactatatatgtaatatacgtgtataaatactcgagctgcatcctttcttttctgccgttattatttcgtttagttactacatttatggtataaattacctttaagacattattattttgcatgtatgaaatttgctcgtgtcaaccccttagtcctccttgcctctgttgtatggaggaagccctttaaacctgtatttagttttttaaatctattagaattaagtacaattgtacagatggtaaaaaaaagtaatcgttatatcgtttgtcagtgatttttttttttttatttcattcattatttatttcttatttttcaatttgttcccttattggggcaaaccacgggtgtcccatcgcttccttag

SEQ ID NO: 14312 - DNA, 433 bp, Saccharomyces cerevisiae
atatatatcctccgtacgtaacatcactatccatatagtagccatgactccgatggacttaaagaaccaggaagtgtctgtttattcataggtgagggaacacctcaaagtaaatattaatgaatatataagatcataattaaacaaatatatagaaatcttttacaattaaagaaaaaaataaaagaaaagggaagttaaaacttcgattattaacagctgaaaaattaaactttgtaatgaaaagcaaattgggagttatcgttaaaatacggcatcatggaaaggacaaaagttccttttaacaaaagcatgtccatttcccttctgggctgcagtcatttgcgcccttttgtgaaaccagttcttaatacacttataatggaaaacacacaagcattctagtctcccaactttctcaccgggttccata

SEQ ID NO: 14313 - DNA, 456 bp, Saccharomyces cerevisiae
ttcctataatgtaatgttctaacaaaaatttttactgatttataaaacttatatagatagatagacacatatatatatctatatatagaaacacaactaaagtttaccatgttttatataatattactaccgctactgagtaaatgtttagcttgtacttaactttcaaagacagtttttttgataaacatcagtacatttaataatacatccatacatttatgttaatttgtttttcctttccacctcagtgcgcttctcttttgaaaaaatcctcaacaggccacgcgaacaaatcttaccgagaatttcctaaaatgtttcaaactatcatttagctgcatacaatatgtacattattaattgagattaacaactttacctgtactttaccgttatcaaattataaaccaccaaaacaacagattaagaaacaatggccccaaacgtatgata

SEQ ID NO: 14314 - DNA, 488 bp, Saccharomyces cerevisiae
cgtatagcctgctggggaagaagaaagggaagatattgaatatattcttaatgtattttttgtacagacgtaaatataaagaaatcaacgcaaaatcgacgcctttttactttttatacttttttactaaaaagacagattttctcgctcatatcataagtgatgtactattatcctccatatacgatatatctgtttaaaaaaaaagaaaaaaaaaggttacttaaattcatactcattagaaaaaaattctagggataacaacaccaaaggtagaacttcgttcaatttatgaaaggtttggccataatggagaacaaatgaatgaagtatataaagagaaaaacgacttaaaagatattattaacaatatctgacccaatactagcgcctgccccaaaaatggcggcattacccaatttgctaccaaagctcttcaagtggctatgtgagctctgatgttgttgttgttgttgttgttgttgggg

SEQ ID NO: 14315 - DNA, 489 bp, Saccharomyces cerevisiae
cgtataaaaaaaaaagtctaaatacaaacataatatatacatgaaataatatcaaaatatgaagaatagggaaggaaaaacagcagagaaaaacatgtgagaggtttttacagccctattatctaccctgagatagctttcttctttctgccttctccctctttcttcttttccgcagtttgtgtttcttcatcttttttttcctctttctcatcactgaatcgagttgcatcactatatttgaaccgtttaatggctcactgactgtgccagtgatccttgttgccgtagccgtcatcatcatcattgtactcagcatgccctcttgcatgggaggcattgtagtgttaattgctgtttgaaaggttctgttaaagtaggacccgcaacttggtttcttaaccaccgtcctagtaatgcccagccacccaggtcgcaatgcccttcctagcatgtttatctcgttctggtgtcgtgtgtgctcgtctt

SEQ ID NO: 14316 - DNA, 463 bp, Saccharomyces cerevisiae
tcagcgtgaactgactgtaggtgccacgtatataatgcgattatttcgcttgtaaattattcaatcattcatgttttatatatacattgtataaccaattgctgctatttttattttttccattattgcttatcaaggcacggggagaacgcacggaaaaaaaaaaaaaaaagaagaaagaaatgaggtaaacaagatctttaggagcggttcgcatattagtaatacactgataatcgccgtacactcataaaatcctaaactactcaccaggtaccgaaacactactgatccgttttttggactggttgttggcacactttcgcttaagacacacatttagtatttcaatccccatccgtcgatatctgaaggaaatctaaaagaaaagctggatagagtaattattttggccatcgtatgaactccaatagtaccatcggaaggaccacccttggagaat

SEQ ID NO: 14317 - DNA, 423 bp, Saccharomyces cerevisiae
atatatttctttttacgcagtctcttcaatctctttatgtgggctttcgcacctcttatttatatatatatatatacactgaatcatataaacttttttttatattgaatctaatatattatcaaacggaaacttcggctgaatttcatacgtatattgattaaagtggaaagggcatcggaaaagtaagaaaagcttaaaaaaattgaaaaaaaaaaaaaaaaaaataaaaaataaaaaataaaaaaacctatacaatacatacatatgtatatgaatataaacctggaacgatgtgtctttaaaaatagttgaacgaactactcggacatacccctacatcacttaaggatgtctactttcataagaggtcccatctgcggtacagacaactgcccctcacggctttggcgtatcattgat

SEQ ID NO: 14318 - DNA, 477 bp, Saccharomyces cerevisiae
tcatatcggttaataagacggaagcgtaaatattttcattgtagacttttcatagggtggcacatacatagtttactttagtttatggtaaatcgttattgtgctaaaagtattattaaataatgttcaacaacatctcaagaggcgaaaaactcatcagaaaaagaaatataaacgcgaaagatcattaatgaacactagccaacaaaaaaaaaggatatatcaggtccactggtattgagattgctagcgaggtcaataagctgatgctgcatcaaaaaatagctcataaagttcgaaaagtcgtcgtcccaggtatttccttattgattttcttccagggatgccttattcttttgtttctccaactcacctataagactctttactgtagaaatgatataaggaaacaaattggtctcaataaaaccaaaagattatttattgtcttggtatcatccattttgcatgttgtcg

SEQ ID NO: 14319 - DNA, 416 bp, Saccharomyces cerevisiae
tttttcccatccgtatctaatgagatatgcttatttgtaaaccttaatgcatctatttaattgtatagtttgaagcatatggatataaaagaataaagagaagtaataatcggatatgaacattggtggaggaaaatttttacttgggaggatatcgaataatccaacttcagggatagtagggcttgctaatgttggtaaatcgacttttttccaagcaataacaaactcaaaattgggaaatcctgcaaattatccattcgctaccattgacgcagaatgtgccaaagtcaatatacctagcgtgccgctctctaatttattgagaatatatcagagtgcgaaatgcgtacctggaacactcacaatatatgatattgctgggctcaccagaggcgcatctcaaggccatggtt

SEQ ID NO: 14320 - DNA, 400 bp, Saccharomyces cerevisiae
tcccttaattaaaaagattagtttactttttctgtagaatgttaattagtttattgcatagaaaatctttaatactgaatgacaaaatttccacaattttttttaaaaaaattatcgacaactgcaggactcgaacctgcgcgggcaaagcccaaaagatttctaatctttcgccttaaccactcggccaagttgccacttattatataagtcgtaagcataatatcaggatcttatgccttagtataagtcaattgaaattgcaatccttgtatgttttatattaaattttgggtgaataattggataattgtttgaaatccattgttgaagaaaggctataatattcgtacacagagtatactagaagttcttctcgagggtcttggaatccacaaaa

SEQ ID NO: 14321 - DNA, 423 bp, Saccharomyces cerevisiae
ttcccagaagattagggaggtaattaattaataggcagatttctagttcttatatattactatagataaggaaattatacgcttgtatgcagagataatttaagttttgctttgttcgccaccattctagttatgacctttatctatcattctattttttattggaaaggctttacaaaaaacaaacagtaaaaattctttaagcgaagtgaaatcgacaatgaatatgaaattggtaattatcttacattaggacttttcaatatcttagtccttcttttctttcatgtgacttagcaccattttcaaagctaatggcaaatcatcatcagagctttcatcatcatcgttcagataattaggatccgcattaccaagggtgctgtgtctgcttaagcttgaaagttggccggaggtagaagt

SEQ ID NO: 14322 - DNA, 469 bp, Saccharomyces cerevisiae
gacgaattgtgaataacgaaataatatatattaatgttaaatatgattacatagctttgtgcacatatctctatgtcatcttttatgcatttatattttgcccatttttaaataaattattaattaacaaatgtgcacaagctaacaaacaggcctgattacatatacacaccttaattgttaccgggtgggtctttactatattcattcaagtccattaattctcttgataagtcagcatcagttgaatcttcgttaggcaaatttctttcaccagcaactctatcttcgttgataacagtgtcctgatccttctccatttgctgatcctcggttccctggtcactttgaactttttcaacaccatctccatcattagaatgtcccactgaacctgaactgtccgatgaacctgtttttattttcatttttgcttccctgataagcctagcaaaatccttccgaaaca

SEQ ID NO: 14323 - DNA, 401 bp, Saccharomyces cerevisiae
aaatatagtcacaattagataaaaagacaaattagtttacatactaaaaacttcatggttaacaaaagtgggaatgaaacctgattcttacatgtgttgaactgtataggaatgaacgataactgcggttgccgtttgaatattcattgatctgatcacaccaaattgttgaatctctaaacataaatccaattcgcttaacaaagtccccggaataccgaatgcttcggttcctagcaagatcaatgattttttagggaattggaaattgttgtctagcttcactgatttatccgtttgctctagcccaattaatgtgtacccttccttctttttctctttcatgaaacttgcaatctcatctagggcaacttcctccatgggcatccatctatcagcag

SEQ ID NO: 14324 - DNA, 412 bp, Saccharomyces cerevisiae
atcaccttgtaagatagtctgaatttttcttaagataattgttattttaatcaaaattatatatataatcataatataatatatatacattctactagttaggatgcacgtataaactcatcatgttaacacagaaggaaaagtcaaaatgaaggagaaaaaaaaaaaaaaaaaaaaaaaagagaggatgacgttaaaaggacaactcttattaattatattattcaaggtatgaaagacgcaccacatgtacatatcacgtaagatgttcctatgtgtctctgaccgaatggcattttttatactacaatataaagatgaaaaaaaaaaaaacaatctatacatgacaatttacaaagtatatttaagcgtaaaccgcttcaatagccttttcaaaagcatccatcccttc

SEQ ID NO: 14325 - DNA, 460 bp, Saccharomyces cerevisiae
aggagatagtaaaaacaagggatcaatacaaactaaacctttttcaatgtggaggagcttcattctgccctatgtcaagaccatttgtaatatacgtacaacagcattcttgtttcataaagtttatatatgtataagctaagatgaagtcacgtaaatagctcaaatgccgattttttaatactccaaacacagaatcctctatatatggaaatggaatcatgaatcttacggtttgtgttttgaatgttccaaacagattttcttagtgttccgatctctgttccacccaccaaacgagaaaaaagtaggtcttcgcgaaaactccagcgacaccgctggtcctttaagttaaaataatatgaatggtggaagaacccagatcaacttgactgaaacaagtctgccaacatagacagctaagaaaattgatgacaagcaaacgggaaaagtcactgga

SEQ ID NO: 14326 - DNA, 446 bp, Saccharomyces cerevisiae
ctacaagatccatagttttattcttcctttcgaaatgcgataatattattatacttcttatatatgcaattaatttctatatattacaagtggttgacttttgtacatcctaactgcgtttagtcttcatgcttatcacagaactttgcatcacgaatattttccaataacaaatttttaatggtaaatttttgtgccacattagtatcgagaatctttaattcttcagtcgggaaaatataagcaaacgagaaagaaactaacacacttaaaagcaatactaagggaaagccgatggccgctatagtatttgtgatagcaaattcaccagcaaaccccgtcaggctaaaggaaagaaatatcagcattgacttcttggatactttcattaaaggtgaagtattatctcttctgttagggtctgaaaacaggaaaaccaaccgttg

SEQ ID NO: 14327 - DNA, 423 bp, Saccharomyces cerevisiae
acatatttcattgcaatctcgcattcttcaaaaaaggtataaatacgtgtctttttagtttctttatagagtgacgttgaagcttagtagtacgttcatacatacatacatacacacacggtacaaaagaaaaatcatatcaataacaaggaagagagactctaactatgaaatagattggatgcgttacaagtgtttaaataaatataagagagtcgatggataagtgcacttattggcttttagaaatggccttctcaacttcttcagtaagtatatctgttagctttgtgccatttcttaacgaaacccactccccattgagaaggtcaaatctgttaggcccggacaatggtgatgccaaccaaatttgcttatttggaggctgtttgtttattacatacgttccaaaagctggaattt

SEQ ID NO: 14328 - DNA, 420 bp, Saccharomyces cerevisiae
tctgaaatttagtgtctacgttatgatatatacacttacaaatttactttccttttttagtatagttttcaagtaaaattcttgaagcggtgttgtttttgtttgttcttcgtttagcaaaagtcattgttaaatacacgctataatatggccatgaccgtaggaccgaatgctgtccgaaaaatgatacttatcacacatttcaaataagatcggttttgtagttcaaagatttcttaagagccttttacgtgtttcttaagaaacacttcacattggctatcattattagtaaatagatttatatgattttcacttattaaggacagaaatgtcgcgatttcgaacccataaaaaaaggaaaagcaccgcctgttctccagtcttcataaaagcacaccgtatagaaagggcggtgaa

SEQ ID NO: 14329 - DNA, 484 bp, Saccharomyces cerevisiae
ttcaataaataatagattcatacttacgatataaaaaatagtagggaagttaattttcgtttcgcagcgaatcccttttagcagaggaaaaaaaagatgaaaccatccttactactttcctcgaggagactcaacagtaaaggttactttcaattcaataaacaaaaggcacagcgatatccgcaattatgaagcttcaatttttttcctttattaccttatttgcttgtctcttcacaacagccatttttgcgaaagaggacacggcagaagatcctgagatcacacacaaggtctactttgacattaatcacggtgataaacaaattggtagaattgttatgggattgtatggtctcaccacaccccaaaccgttgaaaacttttaccagttgaccatttccagggaccctaagatgggttatttgaactctatcttccatcgcgttattcctaacttcatgattcaaggtggcgatttcac

SEQ ID NO: 14330 - DNA, 471 bp, Saccharomyces cerevisiae
gattaaggtgctaaaatgccgtatattcgaatttcattaccatcagaatatatatatatatatatgagtctatattagggactatcatacggtaacccggacctccattacccgcatgactttactcactaaagacgattgtcggttttaaacattttttttttttcatttcgaccgtcggttctccttagtttgttcagtggcaacaagtggacaaacaagaagagcgtgcagcaccattcaccgccagctttgtatcgtcctttagagtgcagcaagaacattaattgctctcacagaggtatcataagaacatccgattcgttcattaactgaaatcatatctgtgttgttctgatcgactctctttgttagttttatcttccatttttttttattcctttcattttccaataaaatttgaacaggatcgatataaacagataaaaaccctccaaagttaaccatttg

SEQ ID NO: 14331 - DNA, 419 bp, Saccharomyces cerevisiae
ttcactgaatataaatacaaaaatgcgaaaataatgtaatatttaacgtatacataacgggcagaacgcccttctaagaagaagaggcatatgctaatcattggctttccttttcttggagccgccatttacaagttgtttgtcacgttgtaatttagattccaaataatcacaaaatttctgatctctattttcattccaaactctattaatgccgccgagaaaaatgacttgtgagtccttcaatatgaaaacgcccctattgaacacagttcccggcagtatcacaattttagaacccagcatgcaagagctccaagatattggagtcgagttgatagcaaaaaaaacgtcgcccgacttactttgtagtgtcaatttaaacactgctttattcttggcggcactgctattattgt

SEQ ID NO: 14332 - DNA, 447 bp, Saccharomyces cerevisiae
ttattatatgatagatttgttaattttttgtatatgcaaatgtgctttttttcaccaaacggtttgcaccaatcatacgagagaagtgttcggtgtttacggaaaagctaggggactaagaaaaattgaaaataaaggctgacagcagtagaaaccattgtgctggcttagtgatttataagaatggttaattagttttgtatcctttaattttctagatagagccacagagcaaactaaacagaaaagttatccatttccattacgcaatgttgtgccaacagatgattagaacgacagctaagagaagtagcaatatcatgaccagacctattatcatgaagaggtcagtacacttcaaagacggtgtgtatgaaaatatcccattcaaagtcaaaggaagaaagacaccttacgccttatctcatttcgggttcttcgctattg

SEQ ID NO: 14333 - DNA, 443 bp, Saccharomyces cerevisiae
gtctttgcggattgcttagttgtaccgtgcgtatattaaatccttcttcgtacaccgtgatttttcagacggctaccagagaaaatatggctgggatttcatattatatatgcaaatatataataacatatatatatatacactccattaataactaatacctacattcatatcaacactttcatcctccccttcccccatagcaatgaagataacgtgtacagacttggtgtacgtcttcattttactcttcctaaacacgagttgtgtccaagccgttttttcagatgatgcatttatcactgattggcaactggctaacttaggtccttgggagaaagtcatccctgattctcgagaccgcaacagggttctcatcttatcgaaccctaccgaaacttcctgcttagtttcttcgtttaacgtttcttccggacagattc

SEQ ID NO: 14334 - DNA, 447 bp, Saccharomyces cerevisiae
gcttgaaagcattattcgatgtatagtatagctatttagatatacagagagataaatgaaagagaaaaaatattggtatcaatcaacgtttgttacaggcttagactttggtttggtaattgaaattcatggtagtggaaataaacaaaattttcctcttcaatttttttcgtcgtttcgctctgcaatcgaaaatcaaataatcttcataaaagaaatcactttcaataaatgaacttctcactaccataatggatgatgtggccgattcgaaagcaatacggttgattaacacggaaaccccgagtgataagtcaccaaaaaaaattctctttacgatgaatgttccgaatttgttctcctctttacagttttcgttggaaaggtatttatatgtaatttccttcagaattctcttgttttctatgttggcattgtcgagatgaa

SEQ ID NO: 14335 - DNA, 453 bp, Saccharomyces cerevisiae
gaataataattgttttattactgcgtagtcaaatatgtatttacagaattcttttaaatatataattcacctactcatcatagccaccgccaaaagaaaggaaacctccagtttgtctggaatgtctcgaaaaataatcgaaatcgatggacacagcgtttgctaataacacggccctttgatccaaagttagtacttgagaacttagcatctcagtaggataaatattatcaaagcatctctgcgaatcaaatctaacaacataaacaccagtatcggtaaacatttctcttcctaaaccaacccaatttctgtctacactcgccattatcttaccatcagcatctgttacaggaaaatcaaatgataagaaaggtgcatctatcttaccaaattggtcaaaagtggatccttctactccatctttctggaataattcgtaacgacgcctcc

SEQ ID NO: 14336 - DNA, 494 bp, Saccharomyces cerevisiae
atataaaaaagaccatataaaagtatatatgagtgtatgaatagtttttttttttcaaacttatgcacgctatactactctttccctatttagtttatgtaaattataaaatatgatatcaattctttaacaaaatttctcgctcgtttttatacttatgactatatgtaggaaaataaacgtgttgctctgtcatgttacttctaaaatattgagaggagaaaaaaaaaaaaaaaaaaaaaattataaacaaatgaaaaaaggacgtactgactaatagtaagtagatcttttacctggaaggtgccctatgataagatttttcatcaaccaatctagctgagcatactgttggcagtaattaggatgattttctcactagatgaagaacttcatcgtgtgtcactagatgataaaaagaatgacattaaagtagattattcctcggcaatatacaatgatatcaatcatgaacaaggcagctccatcacata

SEQ ID NO: 14337 - DNA, 409 bp, Saccharomyces cerevisiae
agggactaggaaataatactaattaaataattctaataattctaatattaataacaataataataagaataataattatacaataacacatgtatttcctaactcacaatcgtttggactacatatgctgtctagtgccttattgcgactttgcccgtttgataacttacttcgattgtttagtattcaaaaaggaaaaaggcgttttctttttcgtgtactttttttcgaaattctgttgaatttattcgaactcagaattggtccatcaagagcatccaaaatacaaaataactcatcatcacacaagaagaagcacaactccaagcaatttctacaatatgtcaaaaaaacttgcgtcaccattgtccttcttacccctttataatttgctttctgctgttggttg

SEQ ID NO: 14338 - DNA, 499 bp, Saccharomyces cerevisiae
catattttgacatttacatagccatctatataataatccttccttcattgaaatgcgcgaatgactcagacgagcaatatcacgtgttgcgattttactttcagtttgcaaagaagaaaccatgccacatataaagaacgtttgcacttctctttaatttattagttagtaagtaagaagtttaaagacaactcagaagacatcagcactttactatggcattggaaagagaattattggttgcaactcaagctgtacgaaaggcgtctttattgactaagagaattcaatctgaagtgatttctcacaaggactccactactattaccaagaatgataattctccagtaaccacaggtgattatgctgcacaaacgatcatcataaatgctatcaagagcaattttcctgatgataaggtagttggtgaagaatcctcatcaggattgagcgacgcattcgtctcaggaattttaaacgaaataaaagccaatgacga

SEQ ID NO: 14339 - DNA, 460 bp, Saccharomyces cerevisiae
tggtggaacgtaaaagaatgatatggaagttcccttttttttatgtatcgtaacgtatttgcaacatctttataatatccctttgtataaagtaaacaatcttgattaaataaacctgaacataatttattgatgtgaatgttcttttattggcattatttcttcggatgaaaagcaaatttcacgctctatgagaaaaattgaaaacgctattctatgtgaaaatagagatgagtactactagtggctacaataaaaatactgaacctttgacaatcgtacaacaaaaggatcccaaaaatgaataaagaccaggcagaaaaatatcaagaacggagtctgcgacaaaaatacaacctactacatgtactgccaacactgaattccagagcgttatcgggactatactataaaaattttcataattctgtgaagcgatatcaaatcatgctgccagaac

SEQ ID NO: 14340 - DNA, 424 bp, Saccharomyces cerevisiae
tagagaaagctcctatttccactgtacatacttcaataagtaagtaagttgcattaattatctatttagaagctagatgctcctcaaatgcacagaatcatatagcgttttattaggtctgttctttattttagttttgttgatctctatgaaggtatatttatatgcaaaaataaacttttaaatatctatggatgcttactcaattgtatagacgtttttcataggagtgcaaattatggacaccaccttctaattgagcagaagcggttctgaattcaaatctaacttcaccattttgaacattctctttcaatgaagttagagattcgcaaccaatgtcttgacaagaatgttgtaaaccgttgtacaaatatggaataaacttcttgatggaacctttgtctacgacagccccagaaac

SEQ ID NO: 14341 - DNA, 469 bp, Saccharomyces cerevisiae
gagctttagaactcggagataatactatataaatatgtatatttatagatatagatataggcatgtatatcttcccagtaatatacgtgtttgggacgaaaacaaaagagaagttggtaaacaaagtttcatgtgaatttgcttagtacaaaaatacatacaaatataaaagaaaagttacaaattgcaaacacactcataacgaggggcaaaaaaagtggagggtgaagaaagtcaagcctaatacatgtacttaaactcagggtttttgtcgcttaacctttcgtcgtatggaataggctctcccaattcattacagcgatctattattgctttctttttatcgttttccctcttgtataggaaaatttgcacaaccgtcataaatatggagaagacttgaaaggccagactaatcgacagccctttgatatatcttggcttgtctttggcaacaaaaatttgacca

SEQ ID NO: 14342 - DNA, 400 bp, Saccharomyces cerevisiae
taatgaaaacaattccccttttttttgttctgcaacttaagtgtgttcaaattcttatctataattatatataaacatacactaaaatataagtatataccaaaatgtctcaagattttctgtaatgataatttgatgttcaatcttttggtctgctcaggggtttttcttgcttactgagatattttctagatatgttgtatattagacgttggtcatcgatactgggcaaatttgactgcattgttgtgttagtatttctaatcagatcgttgaagtaagaaacaatcttaaattcgcttgaatacatactggaaataatagcttaagcgtagacgatttacgtacaattgctgcaagatagaatatcactcgaaatccccgacagaatccttcattg

SEQ ID NO: 14343 - DNA, 485 bp, Saccharomyces cerevisiae
tgatagttgattttatttctgcatttatatatatgtgtgcgtgtgtgttttatatataactgccaatggcctaaacccagatggattggccacgagcttccatttttttgcccagtttttctacttgatcgttccattcaaccagtctgtccttcatctttgtaatttggtcaccacttatgattcttggttggacccaggagatggtaacgagttcatttacttggtcaatagaaccctttaatagacccaaacttatggctctcatgaccaggtgttcgacattatcctttggtaggtgtgtagcctttgaaatatcttcaaatgaaagcatcctaatatttttgacaaaaactgtttcaattaatgtcattaggcaaattttttgtcgtaaaaatgattcatgttgagccaatataggaatctttgatatttgaacttttatcaatgagtcgaatttatcaaaatcaccaacggttagagca

SEQ ID NO: 14344 - DNA, 451 bp, Saccharomyces cerevisiae
atgcagtaagctgtgaaattttatttcagttaatcccttcttttgttatcaatagtattaaaagaaatgcgtcagctttagcaagcgtgcatgcaaataagggaatgaacagcaagaacaataataaaccaaaaaaatcacggatagaatatgacggatcatcaccacacgaagaataaattatgtaatctttgtataaacaaaatttttaaagaaaaatactataatagtttgacaagagaaaacgaaatggaagaaacaggacaacagggcagaaaaaagttgacattatgcaattgatgaaagaagaagaagaaaaaaaacaaaaaaaaagcactagtctgaccaggcatattgtaaaaggctgcagacccttgaacgcactacacttttcactgtattccgttaccaacattactgtttgacagcgatggatgctgatgaattggaa

SEQ ID NO: 14345 - DNA, 427 bp, Saccharomyces cerevisiae
atgcctttaaaattacagaacataacatgattaatgaccttgcgttggatggtctgtcgcgcatatcaagagacacgtcacgacacaacacgatgaatagaaatgctatcttctgggacaccataaacgactccaaaatattttatatgttaagtagcgatatataacaactaataacatatgtacttatatgctctcaatagaatagataacaaagagaacaaaaacgagagtttgatttgaggatataggtgagttgcctcttaatgaacagaagcacctgtagccttagaagcctcattgacggaagctctaatttcatccttttctgtcttgctaacatctcttaggatatatctgtcggtcaatggggctacgatcttttgatagatcattctagcgccaccagtttgaggcaaggcaatgt

SEQ ID NO: 14346 - DNA, 484 bp, Saccharomyces cerevisiae
tatgtgcctttttgtttaaatgatgcactgaactgtacatcactgtgtacctggatagaatgtgtgtttaaatatgcgtattatgtattaataattgaatttaattttacttctgtttttctttttatcgctgtgaacttttttgtcaagaagtcgctctttgttggctttctcttttattttattccatttctttgaggtctcagcagtggtatcattaggaaattggcacgtttgccgaatttcttgaaccaacttctcgaagcattttaatttgttggtttcccttgacctagtttcatcagattgaattactatagaatcgctgcccttagcgtagtatcgaaacctgccgctacttaagatgtttctcacttcctgaggaatccaagcacagtttgataaaccagaaagtgtcaaagtacatttactatttaccttattaacgttttggcctcctggcccgctggctctatcgtaacgt

SEQ ID NO: 14347 - DNA, 407 bp, Saccharomyces cerevisiae
actacaattaccaatattttgaatgcatgtagtgtaagtacaggtatatctatatattatgtatatgtaagagtaccatataaacggtaagcatattaagatcaaattagttgaggctgtaaataaaaatcaccactgagccttcataaggatataatgagtttgcataacctttaattcctctaattcgtccaagaactgtaatgatctgagcctttttctttcagattcgggaatctgtgcattgaaaatttcccacatgtcattgacaataacgttgggagccgcagaccatctcgaagcgtatttctctttagaattatacgtcatcaacgtgggcatttccaaattccttgattctttcaagttggactgcataatggcgccaaatcggtcattcggttgag

SEQ ID NO: 14348 - DNA, 490 bp, Saccharomyces cerevisiae
tttctcaatcgctcctcttgcccttcctcttcttttccttttctttttatttttttctaatttttctatcttttatttctacttctattattaatttgtatcttctaatcgtttttcccactttatcgaaacatttcttctatttatatatgtaaagtatgtatgtattttcgttttatttaaactccaaaaaatgaataattgttcctgcaaatttctagtttatcacgtctcataatcactgcttatacctcaccattccattgtactttgacatatttacccctcatctatatataatcagggcttaagtaaacgcttcgctgtgatttcccaaagtcggttcggaaattataggtcggttatatcatccgaaaaaaaaaaaaaaaaagtttttcttaaatgcataggtttaaagtcgattaaaagtagggctaacacaagtataagcagggttttgctataatagggatgccataagtgagggcag

SEQ ID NO: 14349 - DNA, 447 bp, Saccharomyces cerevisiae
cgaaaaccgaattatattatgctcatcatttaaacaggcacttcttcaacagattgaagaaagtgctttaaatatacctaatttctctttagcgaggatttgcttaaaatagtttctttatacaataataatgaataataaagtgacgttacttccccccagagtttttttctgcctgtcatggtctgtcatggtgaatattgatcgaaggaagagtgatcgctccgtaaatctagatgatcagcattcaaacaaacctccctctgaatcactaatatcacttctatcgttaacttcatctatgtccatatcgtcactgctttcattattgataatagtcgctgtattgtttccaccgctatacattagtggattaccttggataatgtctttcaaatccgtgttttcattttttagtttatctataacctcgtttatcatggtgcc

SEQ ID NO: 14350 - DNA, 450 bp, Saccharomyces cerevisiae
atgcaatgaaacgtatatatgaaatcgtatgtatagatgcgaaagaggaggagagaaggctttatttctgactatcttcctccactaatttgattgatcaatttatttcacaattcggataagtggtctattatatataacaattcgtcatgtaaattggtggcggtgtcggaatgcgaagccaaatcaggtaaatacttattttcattatcattttttatcatattcactaattgattaataaaatttttggtgtaggccaatgaattggtgtcgaattccagtatttgaatcagctttagttttatatctttatcacttgtcctcaacaggagaattcttagaatttcattgtgttgctcagtttgacctttcgttttagtgaagttaagggcgtggacgatgggaaaagataacttcccctctgtaatgtcctcagcaaagcctttt

SEQ ID NO: 14351 - DNA, 431 bp, Saccharomyces cerevisiae
gcttccgaataaatataaaatcaagaaataaggtaataagttgtttgtcttcttcttttttttgtttaatcatataataattaaatagtcatcattataaaaggataattcaaccgtattatattacatagatgcacaaaaactattctgacgtgatgcggtcctgtccaatgtacgattttggtctcaaattgggcttatcatatatgattgaaccctaacaaatgctacagtgacaatcgtatgtaacgattattatcgaacattctcttccaacatccgaagaaaatttttcttcatcatatataaggatcttctaactttcttaattgagttggatgaaaagctatccttttttttgctaagaacaatgccagccaaacaaattttgaagtggcagaaatagctgctattttcagccacgcctaaaa

SEQ ID NO: 14352 - DNA, 425 bp, Saccharomyces cerevisiae
atatctgtgtagtgtgtactagttggcagctgccctttttctttttcttttttttttttttttttttttttttttcacgtggtttttctatgacgttttccaaaacaagcgtgtcatgtgagcttttttgccctttaactttctggttggagagtccaaaagaccgaaaaggtaagaaaacgttttattgctcagtatgccctccccttatgagatgaatggtgttacagcactttgaagagggctcgttttgaggactttttgatcaggattaatactagattgccaaaaaaaggatagccttttataagattactttagttcaaagaagagaccagaaagaggaatactggccataattatagtgcagagacgcaatgacaaacaaatctagcctgaagaacaataggaaaggggttgcttcg

SEQ ID NO: 14353 - DNA, 475 bp, Saccharomyces cerevisiae
aatagaaagtgaaggggttgtgttgcacgacaacgtacgtacatgtattttcatagctgatttttttaccatcctctaatcttagcatacatacctcggactaagtacagaaactaactaaatttgttagtttcaatattgaaactgatcttcaagactttttacctgcaagagacagtacgtaaatatatgagtaatgtagactttcttcgacatcccaattctatcgcctcgtttgagacaacacagaaatcggacttcctatcctgtccaaataaattattctgggaaactcgtatttcaaatcttgtttgaaatactggcaattaactactgttagaagacaggttcagtcaactgtggcatcgtttccgtgtaaaaaataaatttttgattcaccctcttaaaaaaaaatcagaaaaaatgtggtaaatatactcaaaattgttgttgactgtcgaagtcctgccttttt

SEQ ID NO: 14354 - DNA, 413 bp, Saccharomyces cerevisiae
tagagaaaattatgtacgcttgattcatataaaaagaggtaaaaaaaaaaaatagcttctcataataaccaattcggactcgggaaagtacaagttcaagttttttattggtttctatatgtataagataaaaatacctagatctatttaattctctgtcttgggccacctggtgatttcttattcctggctgttaggatttcaacaccatgttcggtaaccaacagtgtatgttcaaattgagcactcagtttaccgtcttgggtggtagaagtccagtcatcaggccaggtcatatccttccaagtaccttcattaatcataggttcgatggtgaaaaccatacctggtttcataacaccaggtgttctattcttggcgtagtggggaatatttggggaacaatggaaaaa

SEQ ID NO: 14355 - DNA, 437 bp, Saccharomyces cerevisiae
tccagccagtaaaatccatactcaacgacgatatgaacaaatttccctcattccgatgctgtatatgtgtataaatttttacatgctcttctgtttagacacagaacagctttaaataaaatgttggatatactttttctgcctgtggtgtcatccacgcttttaattcatctcttgtatggttgacaatttggctattttttaacagaacccaacggtaattgaaattaaaagggaaacgagtgggggcgatgagtgagtgatactaaaatagacaccaagagagcaaagcggtcccaaaatcatttgagtaaccggatatctatcgggatattaatagcagcttccatttcaactaaaacaacagcaagatatgagcgacaagatatcctttctacctcccgaacccatccaactacttgacgaagactccacgg

SEQ ID NO: 14356 - DNA, 455 bp, Saccharomyces cerevisiae
aacatccaagatagcacaacgtagcgtaatacagatataacataatatagtatactacatcataaccacgtgatgccggacatgtacatacgcatgtggcaatatgccaaagccggtttccaatcctacttcatattgccttgtccctccggtttcgccggcaacaacggcccggaacgtacctaaagaggtatttcgctcttggtatccgtacctcacttatctccagcacctatcgttcctggccagacggccggagttgatctttcgtctttctccggaaaccacggcgttcagctacgcattccgtagcagccaagccggttcttgacaccatctgtctacgtcatacatatcggctctttttgtctctaataaattaaagagagccatttatacgaaaaaaacacctttttacgaatttcagaaaatcagaatgggaaaaacaaactgcg

SEQ ID NO: 14357 - DNA, 466 bp, Saccharomyces cerevisiae
tcttttctcacatcctcacttatagatatgttttgattattttcgttatagacaaaaatcttttgagaaagccatgcggaagttatttttaactgtaaagtacaatcgatttcctttaggcatttctactttcttctgaccctgatttaaaattttcgagttctttttgttacgatgcgttatttattgtcgatttattacatataattctttataatataaaagtgcaatacagtgcatctagatatggattttcaaaattttgcagaatatgatcggtttgcctacaagataaaagtaaattattcacaatttccaacatttaaaagtggcgatcgcatagtaaaagcgttaagaatgatgctacatcccacatgagagtggttcgattatgctgaatttcaacaccaattcaatatactttaatttaaacagacatttatgatgccagagacataaaggatcc

SEQ ID NO: 14358 - DNA, 498 bp, Saccharomyces cerevisiae
ttgtaaagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctgttcgatgaatatgctattttcgtggtcatacaagaatacgtgtgtcgtctttgaatggtggcatatcaagaccctgcctggactgatttta

SEQ ID NO: 14359 - DNA, 496 bp, Saccharomyces cerevisiae
gagatgaacaacttctgtttaaaatcgtctcacaaagacgcatcttgcccataatgtagcgatgctctatatctcaaatatttgttaccttttttatgttggtatgcggcgggtatctatataatatatgggtgtatacatacgtagggggaacatcaaaaagaaaataatgatcactcaagtactatttaaaatcttgcctacagaattatcctttgtgatggttcttacggggctttcgtttctactactgctttcactgcatgttctgtcatccaagtcatcgtgtacttgacgtccttcacgaaccgattgcagcatatttggttgttccttcatattggattcaattggtttgtcatgtgaggtaagtgctacggacacgttagaatgtataggggatggtgatctctgtacttgtttttcttttgcttcatcgataatacttaaatcgatcactccaaaggaggatgtggatcttgcacgcctatgcttt

SEQ ID NO: 14360 - DNA, 448 bp, Saccharomyces cerevisiae
taatttggtctcggtatagtcagtgacaacatcaactacttaatatataagaacaaataaaatatcccaaaaatatcatatatcctcatcacatttgcaagtctagcgcttcgatgcgttgtgaacactttgtcaatgtatttagttgtattcatacccaatttattggcacttatttgatactcaccatgcagggtaatagaaaatgtgctgaaaaaaagctaaacctttcttattaagaaaatgggaaccataacagtggtgattaatgagggaccaatactgttgataagggcattgcaccgagcaacgaccaacaagaaaatgttcagaagtacagtttggagacgttttgcatctaccggcgaaattgcgaaagcaaagctggatgaattcttgatataccacaagacagatgcgaaactaaaaccattcatttaccgtccca

SEQ ID NO: 14361 - DNA, 421 bp, Saccharomyces cerevisiae
agtaatgcatgctatgatttcttttagcgttttcttttcatatttaagtttatacatatgggtgtgtttgcttccattcatatccactctataatgctaacaatcatgttactagccatcgttgctatcgataccttatgaacagctctaactccttcctttttaacctaccgccttttgcgcactacccggcaacccctcgaatgtgaattcggtggcaaaaaaggacatatatcagggccgtgtatttaagagatccgcagttgatgtagtcaattaatctagttctattaagatttgactcaacgccattgactcgataactggctcaactacaagacagatatacaaatcatgggtgaagaacataaaccacttttggacgcctcgggtgtcgaccctcgtgaggaggataaaaccg

SEQ ID NO: 14362 - DNA, 487 bp, Saccharomyces cerevisiae
aaaaggagtgatggttttctttatttttaaccctgtaaaatttttttatttttttatttttactcttatatatgtatatgtttgtgtttatttctgaataaaaatttataagaaccaaattaaaaccgttaatagcccacccaaaattgaagtaaacgaactcatacctagatgctgggcctcattatgcgaaactgttttctttattgcagatttaataacgcctacagtaccggttaaagtacccatcccaatagaccccacggagggagaagcgactgttacgtactgggaggagaaacgctggacaaaagtagtttgcacagtgatagtgttgccctgtctaacaacagtgacccacatggacgttggcgcacgtgtggttgtgtaagtggaggttgtaccttcagtgatggtaatgtatgagtcaatagatagactagtgacagcagacacaggaggttctgtgaagtctgtggaggggtct

SEQ ID NO: 14363 - DNA, 406 bp, Saccharomyces cerevisiae
tgaacatcaaattatcattacagaaaatcttgagacattttggtatatacttatattttagtgtatgtttatatataattatagataagaatttgaacacacttaagttgcagaacaaaaaaaaggggaattgttttcattacatggtagataatttgttgatgatttcattcgtgaagtcagtagtagaagaggaaccaccaatatctctagtggtatgcttaccttctgcgatcgtttcatgaactgcctttgagattctagtagcatattcattcaaacccaaatggttcaacattaacgtggaggaaaggatcatggcagttgggttagccacattttggcctttaatatctaaaccaacatgtctggaacctggttcgaagacagcatagtccctgccaaa

SEQ ID NO: 14364 - DNA, 438 bp, Saccharomyces cerevisiae
agaggtatttagaagtgaagagacaaatttatatagttatagaataaatatcagatagataagaaaaaaaaattagttaaacattaatatatatatatgtgtagtgactgacatacgtatgactgctagtaatccagttgccgagctattgttgcagattgaaatgtcatcacgtggacattatatcatcattaacgactaatgcgtcaaaaaaaaaatgggctaaaaaaaaaaaaagcaaaaaaaagaaactcagataagtcgatatggaaaaccttttttcttgagtgcaacccttttagaggttacaaaacaacaaaagtccaaataagtccatagcttttgcctctcaatatatctatacttgcttagagggctacctgtgtgtatttgctagcttttacctttctctatacaacaagtgagggtttgaacttt

SEQ ID NO: 14365 - DNA, 500 bp, Saccharomyces cerevisiae
gtaacctctgcattgtcgcttcatattacatatttagactaattaagtaaatattttgataaatttcaatttcaaatatcgtgtaaaatgatatattagttttcgaatttttttttctgaatataaaaggaacagaatattagttagcttcattgtccaattactattgttacttacgtttaatgcattttcttttctttcacttccttccttaatactccatccttatgcacgggaaatacgcatatcagtgaggattcgtccgagattgtgtttttgctggttgaaatttaattataaaccagaccgtctcctcatggtcaattcggtgttcgcttttgaatacttcaagactatgtagggaatttttggaataccttttttcattaccgatattcattctttcaaagggactgtttatttttctttggaagtaatatcaaaaaataggttagggataccggactgaaacattcaattgagggcccaaccatattttt

SEQ ID NO: 14366 - DNA, 440 bp, Saccharomyces cerevisiae
tgtacatacatacatacacacatacatacatacatacatatatttatgtatatttatgtatatatatatatatatatatatgcgtaattatgcagatttctccttgtgtgctacagcgggtactctgacgccagatcatggcctcgagatcgatatacaaaccactgcatgataaagatgaagttgaatattaaagttaccattgacagtcccacttttccaaaatttgtcacgaacgtatccagactgaaaccttgatcgttagacaactgccaaatcaattggagcagcgaggcgataccgccagtgacatctagaaacacaccctgaatggggaaacaatccatagattttcttgtcgagttatgcgtcacttgtgggatgtacttgattagtgacatcgatattttgagtaaaaacaaattgttgcaatacgccag

SEQ ID NO: 14367 - DNA, 500 bp, Saccharomyces cerevisiae
tggcattgatgtgttcatttttttattgataaaaataggggaaagtgtctatatattttgcgtataaaattctctacatttttttttctttgtttagtatgtgtattgaaacattttatttataggttagagaaacaaaaaaaaaaaaactgcaatttcttcttgtatgtctgtagaaaaaattttaagctgctctcccctgtgatttcatgcgtctgggactaataagaacggtgatgatggttattatgatgcatgggcaattcttttggcataatctcttcatctttttatggtcgacgaggagccgttggcatcataattggaagttcttgacaaagagtcggtgaaattagaacgatcattgttgttagcgttttcgttcttaaatttattcttaatactggaaaataaacttgcatttgaacttgaactttctctatcgtcacttcgattagaattctcttgattgatattctcgtttccatattcacttttgg

SEQ ID NO: 14368 - DNA, 455 bp, Saccharomyces cerevisiae
taatgatcagtatgtattcgtaagcccttttttctcccctatttatacgtatgtaagtgtagatacttaacaaaaatattcacaaattaattgaagaggaaaggtgaaaaattcataactttgcttttcgtttattctcattttccaaggcgtcaaaaatttcatcagcagcttgagataaataatagtgtaatctgttaacactggctccactcttggctggtttgttgacaatattgatatgcagccactcgttattcaacatgtatgccagtccaaacccgttgtcatttacttgagaccaaccataaccgtcaaaatattccgaagatagttgagatgtggagatcaaccaagttgaagaataattaaataagggatctttgaaaaggggcggaatttggtcatcattagattttagcatattctttagaccgaagaaatgacgatcgaca

SEQ ID NO: 14369 - DNA, 477 bp, Saccharomyces cerevisiae
accttgtaaagtaaaaaaaaaaaatagtattgatgtaatttaatttagttgctaatataaattagaaaatacatacatatatatattatgcgcgttttctttcataatccgttctttttacttagaatatattatatatctgtgggaaggggtacaaccttttgctttttagtgtcactgcctatgtgatcggtctgtttcctcttttgcttggcgatggcgttggcgtttttcaaagctttttcttgagctctgcagttttccaagtactctgaaggatctgtttgagcgcttccatcatcgttcaattgctttagtacgaaactaacttcttccgggctcttgcaacgggcaaagtactgaaaaaagactgattttccggggacaattctgcttaacatgtattttgtattgccgatgtggttgtcaaacttcgttgcccactgaataaactcgcgacaagcaacgacccaagat

SEQ ID NO: 14370 - DNA, 465 bp, Saccharomyces cerevisiae
cttcacaaataagaatagttcccatatttatacttttatatttggcattcttcaaagtgaggcgcgaaacatctcgcgtcgtaaatcatgatcatggattgtgacaaaacgatcttaaaggtttcgaataaaatgtgtgtaaatacgtatacttatatatgaatgtgcatgtgtaaacgcttaatcgtgttattgcaaaactaaaatcaggccagattgtagtttaaacggttctagtataactggtttaaggtgcggctcacaacctgttacagggagacaaaaaccatgaatattcttaagcatttcccaagctatgttggcccatctaagattaggaccttagtgataccaattggccattggacgcgaaaagagtttaataatgcggtacagaaactttctgaattcaacgaaattcatctgtctgatgtaacccccattgacagccctatcttcacaccg

SEQ ID NO: 14371 - DNA, 424 bp, Saccharomyces cerevisiae
tattgctgtatagtacatagaggtcgacatatatatatatatatataattttatatggcatctagagcctctagggatattatggagttgcccctaatgacggtctgcaagcctagctggtggttattggcagggtcttcaccatttatctccattgcatcatcaagaacgacgtttaagaaaatatcgtagcctcgcaaaattcctgccactttcctagatccatttatattcagcaatatcttcttgtccatatatttcttcagttcaggggtagaaaccattgtatctgtgcgtgtgtttgcgtaatcctgtcctatgccggatactctatatgcgttgtactttcttatacattcattgcacctttagagatttaatttttcttaccacattgtttctatcagcacaaacgtgaaagagc

SEQ ID NO: 14372 - DNA, 484 bp, Saccharomyces cerevisiae
cgcagacaatgcaccagcagaagtacgtattcgtatataataatgagaacataatataaagcattgtgtagtatttttttcgtatttgtcataaaccataaggactgccgtcctttctattacgctcaattccaaaacatatacaaaaacatgtaaatacaccacttctaatttatcagataaatctctatcatcaatatcattgagatcgtttttgtatctttgcgttttttttcatagcttgagtgtcgtcactctccttttcgctacttcattattgctacctcataactttctctcaagctcaagcatcatctatttctcgaaaagttgcgttggtgatctcaaactctgcccctccagtattaataatgttactttcagtacataagacttcagttccattcacagaactcgtctcatgcacgccatgcacttttatggaatctacgctaggtacagatgtttttgtaccgtggttgcc

SEQ ID NO: 14373 - DNA, 429 bp, Saccharomyces cerevisiae
gtccgatttacaaatatataatggcggccgtctctatactatagtatttacagaattaaagcttagaactatcataactttcataatataccaccaggcttcaaaaaggcattgttccattcggagtttgcttgagtttgatggcccgggtaaaaaggtttgacaaggcaaggggccgtacttattaaaacaatttcaacatgcacaattaagaatgtaagagatatatgagaatgatacagagagagagaaagagagagaaagaggaaggtcaattaaaggagagaactgttgttaatatggcagaccctgatgacaatgaggccgaagccactggattacaacaatatagtggcgagaccactcgcgatgacaatgaagaaagcatgaatgattctttcactttaacatccaggaatagaggcagaa

SEQ ID NO: 14374 - DNA, 500 bp, Saccharomyces cerevisiae
gtcaaataaaattagtgccgacttttttttagcgcgtactttaacgaaataacagatgatttttcacatgatttttgttagataaattttttatatgtaaatgatgataacgtaaaagcactgttgataatttgtttcaccattatgggtaaatgtgtttttctacatgatcctcgttcattatgatatttagcgtgtatataaatgtgaattccaaattattaatgaagcataagaagcactatcctttctcttcggatgaaaacaagggagaagaaacctgtgctggtattaatgctggaatgtcttgctaagaatcatacaaggtggtagttttatttaataaagaaaagaaaaggactagatataaaaagtgaaatgaatataagatagcgttaagagatgcccacagtacttgacacataatttagcgttttctcgggaagctctgtgattttatgattcaataacacagcgtaattgatttcgtgatggttcga

SEQ ID NO: 14375 - DNA, 414 bp, Saccharomyces cerevisiae
agagaagcttttacgaacgaaattccatagacattaaaaagtaaagaaaatgaaataaaatatgttattctattgatataaatacaatttctcatatgtaaatgtatattaatatgacaactcatttttgatcaataacagtgtttgtggagtattttctcaatacaataaacccaaaatagaaacttctcttttgcgtcactgttctggaaaagggtgcatggtaataaagctaatagggtatgtccaataagcaatactgaacttggaaatgtgcggcttcgcagccttttgtctttctataaaaatgtgtcgttcctttttttcattttttggcgcgtcgcctcggggtcgtttatagaatatgcgtcacttttaaaaataagattgcagatcagggcaaaacaagtagca

SEQ ID NO: 14376 - DNA, 402 bp, Saccharomyces cerevisiae
ttgagtactattattatatgacactttctcgtatgctttttgatagttaattgtatattgatgaattttatatacaatgagtgcactatcgttgttaaacttcttacaaccatgaccgttgtgctagctttttattcttctttccaacaaggaaaaactcaagtacttgcattcatttggtcaacgctttttttaaatgctaactgatcaccagaataatgggggtcattttcaaagtgttcaatctcagaatgtaatcttttgacgtttttaatgtcaatatcttctaaatgattcgaagcaaatccatctgttgacatatttacagaaatgtcattccccccttcaatgctattttcaaagctagaatgatcgggttggttttcttccccggtttctagc

SEQ ID NO: 14377 - DNA, 419 bp, Saccharomyces cerevisiae
agagtacgctcacagccgcatagggaaggaacgctaaataaatatatttatatataatcttttcactaatgatcatttacttacctttctataaaaagtggctcatcttcgttctcaacgaatggattgggatctcttttaggattaatcatgtaaacggccgggtctacgtcaagaactactttaacttgcttcccacttccaatccaccatttttttaaatccgaactaggtggtggtaactttctacctcttttgggctcgggaattggtgtcggagaatgcgtagggccagctatcgaatcactgccctcaaaactttcgataacaaatgcatcatcactcaaaactgcaattttctcatcatcatccaatccctctagcctttccataatcttctcgtagatttgcgtacccaa

SEQ ID NO: 14378 - DNA, 430 bp, Saccharomyces cerevisiae
tgataaatcttttatgtagtacccctttttgtatttatatacttatattacccattcatatagatcttttttaatgggtgtattgttaagtttatgaaagtgctgtattatttgtaaaacagcttctaagtatacgaaaattataatagcttcaagtttatattttgttgctagcgttacggttatgtttttacgatacatatcgcctaagcaggtctctgcgcctaaaaaaagtaaacatataaattgggaaagcaatataattaaacatactgctatagtaaattcattactaggccaatttaaccgtgccttattatgatatgaaataccagtcaacaagtcccgcttaaatgcactctagtaaagctacaggtggttaacaaaaattaagaaaacagaacaaccacgagattctttgaacacggtc

SEQ ID NO: 14379 - DNA, 478 bp, Saccharomyces cerevisiae
tgatttgtttgcatctttatacttacaaagtagatatacctgcaaacagcagaatataatgtcataaattgcaatcaagttttcaaacttgctaggctgtatcatgtgtacctgtatagtagtaaagatatatataatgtttgaatttttgataatgcagatgtactgtatacattaaccaagaagcaacctgcaaaaccgacgaactcttggcctgtatatttgttcgatgattgtaatacttttttttttttcaattttttttcggttagcgagaattttcatgctcatctacaatataatgaagaaaattatattagatgagctgcgatctgttacaactagtatactgtgaacgacgctgaaaccttcacggaaaaaccacattattgttattatgggaaagactaaaacaagaggcagaagacaccaagacaaacagagaaaggacgaatttgaacccagttcaaattctgcg

SEQ ID NO: 14380 - DNA, 494 bp, Saccharomyces cerevisiae
gtatcgtattatcgtcaccttccacgagcggtctcgcaattttcgctgagtgaaaaacttgtgaaagataccttgattttatgtaatagtagcttaattcactttcatctgtgcgtaatctctaaaacctactgacctacagatcaataaactgactaaggcgcttgtaaagttattaataactttgcttctacattttttaaagcattttgttgatatttcgaactttcttttgttcatctccttttggtttgactttaacgagaagtctcattgtgtcaagacaaaaaatcaaaagctattatctacagcacatttatttattcattttcaaatttagatttttgaagattcattgtatgtttagtcgatcgacatggctcatagaaaattacagcaggaggtcgatagggtctttaaaaaaattaacgaaggtttagaaatcttcaatagctattacgaaagacatgaatcatgcacaaacaatccttccc

SEQ ID NO: 14381 - DNA, 451 bp, Saccharomyces cerevisiae
ggatgaatggttggctctttaagagcgaacggcatggtacctacttcaatttttaaagacaaaaggcgccgtttcgataaacaagaaatcactttcaaaacataattaaaccaaagaacatgcggttttctaattatgctggcttaattttactggtatttatctacataataataactattaaaaaattaaataattggctctatttatttttctttcttcaacttgcaagagttcgtcaattcatggaaaaatacaaaaatagaaatgcgaattctgtggatcgaacacaggacctccagataacttgaccgaagttttttcttcagtctggcgctctcccaactgagctaaatccgctcaatttctatgctctaaccaccttagctaaaaactcaatacaggattagttgataaatgggtgttatcaactcaatccacagtgttggaa

SEQ ID NO: 14382 - DNA, 435 bp, Saccharomyces cerevisiae
atagataacctttttcttaccttttcgcatttattttgatgcaggtttttatactttattatgtacaaacctgttgcggatgaataataaatctcgctagaaaatgcacggaatattatatgcaaaagtagaaaagtggaagacggctgttgatacagtgacgagatataagaacattttactctatatttaaaaagaactttattaatctatttaattgagttaacacctttaatgccatcgatatggattctcgagttgcactggtacgaaaatacatagcaccatcggtgataaaaagcgattctattcaattgcacggtttagtgaaggcaccactatttaaagcgttgaatagccgttacaaattaggttcactacagatagtacaggatgtcgattggaatgcgaagacaacaccatccgattctccag

SEQ ID NO: 14383 - DNA, 489 bp, Saccharomyces cerevisiae
gtacatattaatacacatagttatatagaatacaaactgctataataatcaaggccgagatacatagttccgcggttttatctgtatttattttgatattggttctttgacacctttttatctttctttcttgcgctttgttcattctattattttggtgaacctccttcgatagaaaaaagtgaaacattatctaaattaaagtaaaatacaacaactggctgtaaaaaaggaatcaaagaactaaagccaaaggagactaactcacaatgcctctgtcacaaaaacaaatagaccaagttagaaccaaagtgcactacagtgaagtagatactccattcaataaatatttagacatcttaggaaaagtaaccaagctgacaggaagcattataaatggcacattatccaatgatgatagcaagattgaaaaacttactgagcaaaatatctcccaactaaaagaaagtgctcatcttcgatttttgg

SEQ ID NO: 14384 - DNA, 463 bp, Saccharomyces cerevisiae
tcttgaaaaattgaaaatagactttatattatatacctttataaatccaaggtcaaaatccttctaggaatgagcaattctattgcatctttttctacattaaaggatttcagcatttcgatatctattcctagtttttggcactctattttgcaactttccgggaaaaaaggttcaaacggatattgcaaataatacatgatcagcacatttttcaattctttgcttatgtgatctcccgccatatatagtcttaacgcaaaggccatactcttgcaactgataatgggtggtacacctgcatacccagtacataatccaggaataataagaccatcaatgtcttttggagaatgcatcaaggcattccacatggcgttgaaaaccggttcaaaccctgtcttgaggggattctgcggattaaatataggagctgatggggctacaacggtcggaacatgaa

SEQ ID NO: 14385 - DNA, 477 bp, Saccharomyces cerevisiae
accctatgtaacaaaagtgtttatttatattcttgtatttattctaaacacgaactttgatcgtctaacaattgccgcagttacacctttaacaatagtgctttttattactgatattactcacctgattttttgttacccgaatgcaaatttgattaggaacggggattgttaaaagacaatggcagtacagataaaggttagatgaagcagcagtagaataaatcagcatctgtagtacataggttcctaacagcattgtgaaaaaggttcaaaaatgtctggtaatagagagcaagtctttcctacgcgtatgacgctgggtttgatgaagaccaagttaaaaggtgccaaccaaggttattctttactaaagcgtaagtctgaagccctaacaaagagattcagagatattaccaaaagaattgatgatgctaagcaaaagatggggagagttatgcaaactgctgccttttc

SEQ ID NO: 14386 - DNA, 455 bp, Saccharomyces cerevisiae
taagtggtgtatatatatgttcgaaggtattgttgtaatattttcatagttgtattcttattccaccggccccagctaagcattaatataaggattcgtaaaacaaaattatcgttcacatactagagaaaatataactataaaacaaattgataccaatgtatatattatgttgtaaactccataaagataggccgatcctactcgccattattaataaattataaccaaaaaaaataaagaacgcaatttgtatggggtcaaggaagtcaaaaccataagcaacacataactaaggacccaccagggtgaaatcaaccatcaaaataacaccattgcttccattttcaatgctctcgacggcatgaaatttctcgtctctggaggaagctacataatatacttctccttcttttttgagtaaaatatcaccaccagtttccgaatcgcttttc

SEQ ID NO: 14387 - DNA, 455 bp, Saccharomyces cerevisiae
tgggcctacaactactacaaaatcaaataaataacattatatatctaaggttagaaaataattaaatgcaaaaaaagtctttattcctttttagatattcgtcacatcatgcttttatcatagatcgcattttgacaggtacttcgctatattagcctaattaattttggtcttactaaagtgagtaatgccgaaaaattaaacgtttgaataagtgaacctactacaaaggaaagagaggaagagaaaaggataggactaaaagacttccttatatttttcggtacgcttgcgtttcactgaagagaataaaaagaacaaattatataaatttaacacactatgagcacgagaacaaaggccctgaatgcatacaggcatggcttaagagcaacccgaatagctttccggaatgatgctgaagtattactagccgcgagagctaaaatgcgttc

SEQ ID NO: 14388 - DNA, 429 bp, Saccharomyces cerevisiae
agcctttttgttccatagtagttgtttactacgcgtgtatatcttctattcaatgtattaactagtataactcccatctatttgtataattaattgaaattaaatatcttgataactaataacagtactaagaacgctacaataatatgttagcgtgtgcaaactacctatagctagtatatcgattaaatgtttgaagccacatgaattgagaaaggtaagcacatttttcaaattgcagaacgtatcatttagcgaatctatcgtctgtttgaaggttcttaatggagatgagaagtgtttaagttggttgagcgcataatcatttgttacgtgtatttcttttctttttttctttttttttttcgaaggcaatgaaaaaagaaatttaacgaagatgattctagaagattccttttccaaagagca

SEQ ID NO: 14389 - DNA, 416 bp, Saccharomyces cerevisiae
cgacccagcacaaaggctcttacagcttgctaaaagaaattgaacgcgacgctacatgaactacttctttctcttacatagtcttttcccttatgtatcttttctgtacattaatagacgttcttacaaggtaaaatttcaccgcgtttttaaatagaatgaaaaaaacgttgtagagtgaaagaaaagcaacaaatatacagttcacaaggcagcttcgtatagtaatacagcacgaaaaacagctcatagaaatggtaacacagaccaatccggtccctgttacatatccaacggatgcttatatccccacgtatctgcccgatgataaggtctccaatctggcagatttgaaaaaattgatagaaatggattccagactagatttgtatctgacaagaaggaggctggatacg

SEQ ID NO: 14390 - DNA, 411 bp, Saccharomyces cerevisiae
tgttatcaagactttttggacaaggacgataaaatgatataagctcatcaaatctatattgcttgctgccatctaaatatggatacatacagatatatacttgcaaagatcggtccattatactacatagaaagcaattaaaagataaaaaaacccatcatgatattctacgcttttttacttagccatgttgttgaatgtagcttcaattacttctgtctgtctaatttattgctactttttcacttctaagtgaaccatcacaacacatatagcatagtcgagaaaaaaatcaatagctattactagatgatagataccgtatatgccacctacagcttactagagagcttccggaatgatagtatcatttatcaaactaccggtatggttgtgtattgactgcgcctc

SEQ ID NO: 14391 - DNA, 432 bp, Saccharomyces cerevisiae
ccaataacttgagcgaatataactattatataattatcaaagtcattatttgtttatgattatagtgctcattaaccattgaacgttattattgacctcatgaaagatacttctctttcgtcaatagcgatatacaattaggcgacatgttgaactaagagatgtttcataacatggttcatagtcttaaaggattacgttaaatttgtcagtaaaaaagtggtttgattcgcataacttttacaaatcacgaagtctctcgattggatatggagtctctttttcctaacaaaggtgaaataatacgcgagttactgaaggatcctttaatattaaaaaatgacagcaaaaggtccaatggcagtgagttagaacttgattctagtgacctactacaacgcgaggcaattctagccaacgaactgaacatcc

SEQ ID NO: 14392 - DNA, 477 bp, Saccharomyces cerevisiae
gaggagatgaaacaacatattcgaggcaattttggcaatattatagtcattcaagagaaaacagtaaatgtatgaaaaatggcaagaaccttatctctataggcttaataaatctgcctttttggccaatttttcaaaacagatcctatttcttatttatacacaatctatatttaacataattaagtacgtgatgacattgaagataataataagtaaagagtttacgtacttaaattttatatagttttagtatacttgcaatgtgtgaatggatctagtaagctgaggtacttctctagcgtgaatatgaaacgagtaacagggtggtacataatttacgaacagaactcaagttgataaatcctttgcgttcttaaccatttgtaaaagttcgtcaacaacattgaaaatattgcttcgagcagatgttttatcgtttctgcaaatttccagtcctgaacacctctgttgtcg

SEQ ID NO: 14393 - DNA, 478 bp, Saccharomyces cerevisiae
gcattgtgtcagagattttccaaaatccctgaacgacataaaaaatgaaataaagtgtgcctatatctgaaagtatatagtcagtttatatgaagatttttccgagcgaatgcttttctatccatgtatctatgtccgataatatggtgaaagaaaaaatagataatttcaccttagagaatctataaacttggctataaaaccagaaacgagtatggcatgttcaatatcttggtggaaatgaaatagataagaacttcattttataccagtaaaatagtcatttagagattcgtttttatccacaatttccttatacttcggaagtttatcaggttcgactgacttcaaattagaatcaatcttcgaacaaacaatcttcagtagatcttcatcccatgttttttttagcacaatgaaaatattcaagtaagttagcagtaataatatatcactcttcttggcatctgccgtaaat

SEQ ID NO: 14394 - DNA, 420 bp, Saccharomyces cerevisiae
tctgtttcgcccaatcaatctatacatttatttactgtatactttaatgtacatcttcttttatcatacctactgttaaaatcataatattaattcatacaatatacttaagaaaacaatatacttttcttagtttcataactttggaatctataatgttgtttttttttttttaagtatatttgtatattatgcatataagtcaacgcgtagcggtggtattacgcgcaagcttttgatttctcttactattcttggttgttcatttgttatttttctttccctgatatgctgcacaaaactcagtaagaatagttttcaattttggtcttttgattggtttcgataaaaatccgttcattcctgattccaaacattctttaatgttgctatcgtcagcaaaagcggttagagcgacaa

SEQ ID NO: 14395 - DNA, 453 bp, Saccharomyces cerevisiae
gcagaagattagccatagcagattatactatattttacgtagtgaaaaaataggtaaaaattcgttaattattctgatgccacaccagaaaatctgtgggaaaatttttcgagtcagaaatgataacactaacacaggcttcgttgttatcgtgcattgaagttagatacttctactatatttaatctttaatagtgtcataaaagtattattggtttcgggcgaaaatcgtcattttcgcacacagaacttcaaaagaggaaaggccaaaagaactaaaaccgattacttcggggtgattttgttctggcatcttctggcactcttgggcatccttagccatttagtatatttatgaatacattaaggtgtttgacacaagcactatccaaaagtgggagagaagctccaaaactatatcagaaagtaatatttccaggcctgttcagagag

SEQ ID NO: 14396 - DNA, 445 bp, Saccharomyces cerevisiae
tgttattgctaaattgagtacaccctgtatatacagatacataacttatcgatttaaggtcttttaatattaaacggaaaattcaaaaaaaaaaaaatttactgaaaatatcttgagatacttttcttcagctttctttttgtttttttcctcttcttcttgggcactgctctttagtttttatttttagttacggcaaaataaagatgggtctaaaaattacaaaaggacagctgagaaccaaggatctgaatcaatcatcctcaaagtcatcgcagtcttcaagaataggtgtagacacttgtatatttactagaatgctaccccgaataaacactgcaattaatctcacagagcatctgctgagaagatcttttcattcactgacaaatctacagaaaactcaagtaaaagaaagactacatgagctagaacgtcacggttt

SEQ ID NO: 14397 - DNA, 402 bp, Saccharomyces cerevisiae
aatttcatgcctgccttattccattctcttcctatttcttaaattgaatacatctatgtacattatttatttttggcttgattggctcactaaaataacttaaacagggtatatagaatgaagaatattaataacgccaaacccaccattctccatatgctattaccagcctttaatgatcgggttaaccttgaggacgaatttttgatatcggtaaacatcgatcccaatgaatctgtcatttggtttatgacagaactgtcagagaccgctcggtctccaatctcttggtttatgtttctgaatgtagctaatttattggctaacccctctagtttcctatcattctgtttaaagtacatgtacatgaagggatgatacatctgctcatccggtgtacag

SEQ ID NO: 14398 - DNA, 418 bp, Saccharomyces cerevisiae
cgctgatttcatttaccttttattttatattttttatttcattctcgtgtataacgaaatagatacattcacttagataagaatttaatcttttttatgccaattttcttaagtagaattttacaccacgcatttataatctgccgtatgttctggtatttactggttaggaatagataaaaaaaacactcacgatgggggtcgaacccataatcttctgattagaagtcagacgcgttgccattacgccacgcgagcattatttattgaaaaaacttctcagctgactccaccatattaacgtgttatagctaatgctggaatgaaactttaaaatatcgccctatttaggagtactcatgttactagttgagaaatgggtgaattgtgagataattgttggggttccattgttgat

SEQ ID NO: 14399 - DNA, 442 bp, Saccharomyces cerevisiae
acctcgtcggtttatctgcctcaactttatttccgctcctcgtcttttataaaattcctttcatcaatacatctatatattcgaatatatagataaaccaatacaaaaacatactgaaattttttgaaaacaactaaaactattcattgcagttacacgtgaatgctaaactttatatcgctcttgtcggtcccgcggagttaacatttaacggcttctcgcgcaataaccggaaaaattccaacagtttctttgtaatattattaagccttcttttttcccggaatctataagaggggacgaaaattagccgctattaattctggtattgccacctagacaagaagtaaacagacacattacgttagcaaaagcaacaataacaaacacaaccatggacaagaagaaggatctactggagaacgaacaatttctccgcatc

SEQ ID NO: 14400 - DNA, 463 bp, Saccharomyces cerevisiae
cactccgctctttaatctcctggaaagcagtgtaaataaaaatacagcgtcataaacggtactatataaacacgtagccatttaatagagccaaacataagtgggcatatatagtaaaaatttaaagaactatattcgcaaaagaatctcagtcgaaagaacgttttaaaacaatctttttaatcttgtttcgctcggtttttagtttctcttcttcttcaaggacatcagagacaaatttcacatccgttggtaattgtaaaattcttgattgtgtcttcttaccgcttttagtcaagaacgtaaatgcaatcttctttggcttggataactcttcgtaggtctccttgcttgaagaaggttcttcactcttttttaataataaaggtttttgaacgctgactggcttcgaaattactggaattttactggcaacaaccttttcgcttttccttgcgtctat

SEQ ID NO: 14401 - DNA, 404 bp, Saccharomyces cerevisiae
gcaagacaaatgaccagatataaacgagggttatattctttcgttttatacttttttatttttggtatttcatttatcctatacagtaaatatacatagggctaaggaagaaaaaaaaatcacgtcgaatataaacctaattgtgttctatattgcggacatatatttttcgtagattgaaaagttcttaaacgtaatttttttgacgaccagtgaagaggaattgaataagtagaacttgggcaatacttataacggcaatgataatgataatcaatatagataaccaagtcaaccttgattcggtggaattgacggtagacatgtttctccattctctggctctcaaatagttcaaagtcttcgtgattttgttcaagtttctatctatttcctccacggcg

SEQ ID NO: 14402 - DNA, 442 bp, Saccharomyces cerevisiae
gaacaaatgttccttttccaaaatatactatgtgtagttgatcgaatatcagtaagtcaaaacgtattttacttgtttattattattaatactccttttcgcatatgttttatcactttacaccatacaataaccactaaattcaaaaacacttattttcaatatttgttatagaaaaataaccactaaaatcacctaaatataaaaatattctaccctttagcaataagactgaaacactttacttggggtaagaatactgccatggtgtcattaacatgaaagttcaataatgttttcatactaatcaatatgtacacaggcttcacattagaacatcatatattaaagcggtaacttaaaatccagataatacatttttggtcatataagtgctttttttttgtaggatataatcgcaaatgatatcactacactatga

SEQ ID NO: 14403 - DNA, 418 bp, Saccharomyces cerevisiae
ggtcagcgttcagaagcgttccaataggggggggggggggtatttcgttgatacctatgtggctatatagtcgatctagctttaaaaactctaaagcatatatacatatatacatatttagcgtcatgccaagaattcataatttcgaagactgttttctacatatcttatgtggtgtacggatatgaatttttttaccgaagacaataatgcatgggtgttaattctatttttttttttttctaattcagaatgaaatttttttcttgctggagattacagtggaaatttcgctccaacacacgcactctctctgacttggtgctgccgtgagattctggttcctcaaggaatattgtatgagataatttaaaacaaattgagttgaagattcatcaattctgccattttggatcca

SEQ ID NO: 14404 - DNA, 430 bp, Saccharomyces cerevisiae
actaaccgaaccggagaaagacgaacttctaataggatgtcattttagcagtgaatataaacccaagtttctttccaaacgttcacatacatcaagcagccaacattcgagagagcagagattacgtaattatatacaaggaacctttatctaaacattttcttcgaaggtattattttcatattaaacgtaataccatttttgcacctcaggcggtatttgagaagggggtttaacactatcttcaagtgtgacaccattaccagccctttctgtattaggcaggttgtcatacttctcctggagtgatcctgaaatgaggtttttccacgaattgtgacatttctttatagtttggatggttttattggaattttgatactgttcatgaaaggcgaaactatttaatggcttccctgctggaacttta

SEQ ID NO: 14405 - DNA, 479 bp, Saccharomyces cerevisiae
agaagaaaatcgtttccaccaaattctaagtatctgccattaacattcccgctgagctgatcataaattatccgcgcttcttgatttttatgtttgggcgcagaaaacaagctaaaacggtgagataggataaactataatataattaaattaaaaatactgactatataagctagaccttataaactctgaatataaaatctttataaaggtttgaacatttatggttcctgtttggacataattgtgtcgataacatcagcaccaacggcttcagtataatcatcatccgacaaattggttgctggaccgtggtagtatttcttcttgtaaactttgtagtagatacctgcaaggatccagataccgggaccaataacgcatgcataattcattgtggatttagtaataccatgttgttgagaggggaacataaccaaaataataatgaacaattggaaagcaacacctgtccaagc

SEQ ID NO: 14406 - DNA, 414 bp, Saccharomyces cerevisiae
ggtgcttaaatgatgatgaataataagaaccataatgaactaaggaagagaaggggcttattccctatcattcccgtcatacatgagtatcatacttgataggttcagtaaataactaattcatactgtaaattcatttatcaagacaactataatatagattatttacaaacttgtaaactcttctcttctaaaaaaacacatcacataatactaagctgaaacaaaaagaatagtatatatttcccaaagttgcaatgccaatactttttcaagtaaacattaaccaaggacttcgcaaagaattttgcgaaaaatgggctgattttcattttacttgttggatccacgaaggtgaatgtaagaagcatcacgatgcaccgcaatttgttgcccattaatctgcgccttttc

SEQ ID NO: 14407 - DNA, 459 bp, Saccharomyces cerevisiae
ctttttatcattctacaaaagaccagtaacgaagtgtaccctgtttttctttgtcgttttcttctataatgaacaatttactttacggtctttaatcgattttaatgattagttgggcttttggctacatatgtaaaattacatataatataatggacacataagcaaaaaaaaaaaaaaaaaaaataaacaaatgagcaacccatcaaataccaagaacaaagaatttaatataatatatagttattaaatttaaatgtatatatgcagttctgctcttattttgtgaccaatttctttaagtcatccaaaccgaccttgccactattagatttgcttgaattttgcgacgtttcatgataacatgtcgagtggaaatatttgccattcacttcaatagtatttttccaaacccattcaccagattcttcatcataaacgccagtaacggtttcctta

SEQ ID NO: 14408 - DNA, 421 bp, Saccharomyces cerevisiae
ccatcattatcattaaaatatcaacccgaagaacaatgtatacatatacatatacgtacacatatacatatgtacatatgacatacgtattagccgctgaggacgcggacgtataaaaggacaatacttatatggagctaaggggagcagttacgcaactccgtgatcgcgcgccacgggccgtcggcggctgttaattgaagaaaaaaaaaatgaagaaccacaaggggtgatccatataggtgactagcatcatcccctgcgacgcgcggcccgccgggccaaaggcgggcaatgcgcgctgctgattggcctcgaggacaacgccctcaaccacatccgcaacagccaatcccatcggagcgtcaaactaccaaagtagtgattgtatggatgaccactgtattgtggacggtaagcg

SEQ ID NO: 14409 - DNA, 485 bp, Saccharomyces cerevisiae
aaatgaagttaacgttagaaaaatcgtacgcacatacatacatacatataggtacatatatacataatgagaagaggagaaaatgaatacttatacagtaatgtttatttttttgggattaagtgtcgttgtggtgatttctttacacagccaatgggtattcgccagcccagtcgtaaatttcctttttccaggtgttcaaaacatcagagccttcgtcgaccttggctttgaagtcctttaatctacaagcatcctttggcaagctttgttgaacttgttgagcgaattctacagccttgttaatgtattgaacaattctgtggaaatcttcttcacccattcctctagtggtcatggctggagccccaatacggacaccacctggaaccaaagcagatttgtcacctggaatagagtttttgttcaaagcaatgttaatcttttcacaaatgtattcaacacgagcaccatcaacacccttt

SEQ ID NO: 14410 - DNA, 445 bp, Saccharomyces cerevisiae
ttttacagttacatacccatcaatacatacatattaatattactatactcaggagttattagaatgagactaaaaaaaaaaatgtttgaatgttataaatgaatggatgcgaaggtggaaagtgagaaattaagcttgtgcggtgttattgtgatagtttttcaaactttctagagacgaagtatatagttcagaatcagattccaatagggtaaaatcgagttctaatggctggacagatttaccgtctctatctagatctttgtttaagtcatcgaaaaacgttctttcacctctacctactagtaagttataagcggaaccaagttcgttagctcttgctgttctaccaacacgatggacatattgttgagaagacattggtgggtcatagtttattacttgagtgatatcgttaatatcaataccacgggacatgatatcg

SEQ ID NO: 14411 - DNA, 456 bp, Saccharomyces cerevisiae
atagcgataagtagtgtttctgtatgaaaaataggcgagatgttaataccaaaatacaaagtaccttttgcaacaagatagtgtcccatttatgaataagtacattgaaaaagaaggacgtaatgaaaataacattccgtaggaaatttgacaaggctatttgccatcttaagtagtcagcattgaggtatattttccaaagcgcgacgttacgtgttaccaaattttgaatctaaactagcccttttctactatttccactgatctaccttacgattctgcaaaaaactaccattaatatctgttgaaatcagtggtagtgctccttgtatgtcatacatggttagtgttccttgatttaagtatttggctacagcttggacattgccgaagggcggcagaactgtctgataattgctgggattcaaattaacgatgagggcacaacatcaccta

SEQ ID NO: 14412 - DNA, 477 bp, Saccharomyces cerevisiae
taaatattgtcgaaccgtactttgcaacgaaagagtagtcaaactttgttatctttatttgttattcctcttctgccgatggattgttttttactggatcatctttgcggcccatattgaggagatggtgaaattcataaaaatcattacgagagaatgataaattgtaacagaatttataaatcctattcatatagatacatctgtttttccttactctgtttttattttgttggtaacctttgaatcctttttgatgaaaaaaatagaaaaaaaaaaaaaaaaaaaatgaaagcaatatcgactgtatgtatatgcgcaccataattttcctattaatagtttaagcataattagtgtacttactaaaaataatgtaactttgctctttgcaccaatagatgttactctccaaatatcttacaggtcgtcttccacgtggtatctatcaaagtagccagatccacgtccttgact

SEQ ID NO: 14413 - DNA, 448 bp, Saccharomyces cerevisiae
ggtctgtaagtccatttttcattttttcaaaattaatagttttttcggaatatacatatacatttttttacatacacataaaaatatttctctcccttttacgttcatccgccaatcgataaaaatgcattttatatacatgaaatggcgaattctttttggtcgagtttatgtatactttttcttattcaacccataacgagcttcttgaattcttccatctcttcgtaacaattcaatggcttgcccttattggccaaaagacactcagtcaattttgcctttatagaaatgctgccgttgtcggtttttttatcagatttacctttggcacccccatatttctccaacttttgtaactctaattgatcaaataatgttagtttcttgttcaacgactcgatttgattattcaatgaacttgatgatattccatcaacggcatcct

SEQ ID NO: 14414 - DNA, 422 bp, Saccharomyces cerevisiae
tttgttaagaatttctccgctgagggtgaaggctattctttgttacattttatttagtaatgcgttgatcctttttgatagattttttttttgtgctttaaagatagtagcagtatatatgtgtgtaaaagctaatcatcagaagtgcagcattcattgctagtatttagtgataaaaattttagaatttccatttctaattgtaattgcttttcattccaatacatgtttgagcttctggggggtaaaaatacatttccagacagggcgtcaggttgaaagcagttactgaaacatagagagtcgacgtcaggaggaggcttcaaatggttttctgaaagtgattcggtcttatttttccattttctaaaatggtgaatcctttctctggaaatgtgtgatccctttgccttttgtgaaaa

SEQ ID NO: 14415 - DNA, 452 bp, Saccharomyces cerevisiae
gacaaattgtaagaatggttaaacaatttttaattatttaactttttcagtttttgtcgtaatgtattgggcaccttttatgtccttttgacttttttgtagtttattctcacgtatacttaccatctatagtgttatttcatatttaatcatatttccatattagatatctgccttcccctgtataatagttactatgatttatcttgctttgcctattcgcgtcatcaacttcttttcttaccgatcgcggtaatgccctttaagagtggcatcaacattggcgtaaacaaagtttcaaaggattgatacgaacacacattcctagcatgaaagcatggaactctcatcaaacttaaaagacctatatattgaatggttacaagaattagttgacggattaacccctaaacaagaacaactcaaaatagcctatgaaaaagcaaaaagga

SEQ ID NO: 14416 - DNA, 441 bp, Saccharomyces cerevisiae
taagtaaatgcatgtatactaaactcacaaattagagcttcaatttaattatatcagttattacccgggaatctcggtcgtaatgatttctataatgacgaaaaaaaaaaaattggaaagaaaaagcttcatggcctttataaaaaggaactatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagcatagcgaacgtgtaggg

SEQ ID NO: 14417 - DNA, 411 bp, Saccharomyces cerevisiae
ctacttaaataaataatgtataccccccgaagaaaaaataatttacattggagaagaaatctctaaatgcaaatagcgtaacttgtccacaaacatagacgtgtacatgttacttcggcgaataattttttattactcacttcgtgaacatgctggataacgtgcatgattcaattaatttattctgccattgtaggggttcacagaatttccaatacctacttcaattctcccgttattgccagagacattaataccggtagatacaccttgcccggagccattgacgctgttgacactagggggagattggatactatttacgctagtattgggagagcttatggaggctttcatcgtcatgaggttattgttaccgtttttactactattattgttgtgggtgccaga

SEQ ID NO: 14418 - DNA, 492 bp, Saccharomyces cerevisiae
tatattttatcactcctcaaaatcggattatgtatgttgatctttgtttaattacgccttttcgccaaagaaacaataaaaaaactatatattagcttattatatccttgttcacctttggtggacctcccacgatgggtagactatgggaacacttccaaacttgtaaaatattttcttcttcagcacttgctaccaaccaaggtatttgagggttcaaatcaaaatcattcactgaacttctgtgacctgcgtggaccatgatcaattcaggaacgccgtcttccgcgtcatcaggtgtttgttctgctccaatttgtttcaaatcccacatcatcaatctattgtctgacccgctggatacaactacaccgtcaacatgggttgaaaattccaaattgttcactgcatcttcatgacccgacatatggtgtaatggttccttcatgtttcttagatcatatagataaacatacgagtccatacctgcgg

SEQ ID NO: 14419 - DNA, 445 bp, Saccharomyces cerevisiae
tcacttccgagcgattaatacatatctccatctttttaaataccttttttaatacgtatgactctaagtagtaaaagtattatgcatagttttagccagatatttttgggcccggaatatatcttttcgggaagctcggagtatattgcaccgatccgattcttactccatatcatgccatttttctttcctttctcagcgatgttttgtaggaaatcacttagaacttgccttactttaaaagcatgttgagtgaatttcacagatcgatatgctttggtgttcaatcagttcaaccatacctgctattatataatcttcgactcgcataatataggtattccatgcgcaaatagattacttgcaaaatggacatgactaaaaaccacaccactgacacagaggagtttgatgatggtgatatacgtccagtcagtttgggaat

SEQ ID NO: 14420 - DNA, 433 bp, Saccharomyces cerevisiae
cacatgtgaattctttcttttacatacataaacatagaagaaatccaaccctgatatagggatttataaatgcgtgtgcatatctatatttatacatataaagagaaaaaaattgctcatgataaaagaagtatcgcctgcccactttcctaaatcctcgaattttccctatattttgcgaacattttgcctaattcctcttgaatattaactttgaaaacttctaaaggatatagtttatcaaggtcgataccagaggttgttttcctatcttctctgattttatcaattgttggtataaagtccatatatcgggccaaaaagtgttgctctttcacctcagtaggctcaaatctttcgtctactgtttttatcaatccaatagaatcgcaccccttcggtattaatatctcactgcgtgtgaccatttcaa

SEQ ID NO: 14421 - DNA, 416 bp, Saccharomyces cerevisiae
caaacggagccgtcaacactatattactatccatctgctacataataaaataaagaaactaagaaaaaattagaataacatccgcttacaatctaaaaggctgtttcctgatttttaaatatgcaactagccaagattaactatatactgtgattacgatgggctgttaaccttctgaatgctcttgttatttactggagacgaaacatgaataatatctccgttcacaacattaaaatctgaaatggggcgaaaattatactttatttcgtttatcatcccttcagaattttcatgaaataacttaacattcagtatgtcaaagtttagctttcgacatattacactcttaacgtaccttactgtaaaactgggaaggacccaataatctaaatcactactcggcttcttgccag

SEQ ID NO: 14422 - DNA, 438 bp, Saccharomyces cerevisiae
gatttcaaaactacatattacagaactttacatatcaatattattctcaaaaagcaactcacaagcgtagtagatcccgctgtaacctccatcagctggtatttggtcattttccccgaccgatgcaatcaacagtagtccgttttgtttgatgatcctagccaacgacgggcatatcttcagtacttcatatggaagcgttacacctaacaaattattgttcatagcaaattgaaccattgtatgtatgtttattagttccgtgtttaaatacgacattttttgaggatttacggccagttcctttaaacaattaggagtatcacctacaaatttgcctgtggttgaatctctgagtagatttttcatttgcaacaaaaccggaaaattgggttgtttccagttaaggatcgagcaagcttcccaattgcatgaact

SEQ ID NO: 14423 - DNA, 441 bp, Saccharomyces cerevisiae
tccggtctttaacttggttatcatacaatattgtttttattaaatgtttgtatatatgtacatatacatacctatatattgatcaatgttcttgccgtacaaattcttcctctagttgttcctttagttcacggtttttgaataaagtatccgcagtattcattcgttgcagaaaggtatcttgaatattattttttgtgttctggaaatcagcttttagtttagtaatccattccagtatcaaagtcatatccagatcatgttttaccagacggttcctctcagaaataactttctttttcaattccatgaaacggagccagttggaatgattctcttctatataggcaggatcgtattgatcttccaaatggagacctctgacgtccatatatgccattctttgcgaccattgacttatcattacatcgccccactctt

SEQ ID NO: 14424 - DNA, 476 bp, Saccharomyces cerevisiae
ttgctctgagaacatttatacattaatacatacgggtatgtatgaatcatattcagtgaggagttacactggcgacttgtagtatatgtaaatcacgttagtgagaccatttagaccctgtcaatgtttcataagcctctatatatttggcccttgtcctgtcgacaatgtcttggggcattttgacgccgttaacaccgttcaacttattagcagtaagccagtctcttaaaaattgcttatcgtaagaatcttgggattctcctaccttataagaggcaccgttccagaatctagaggagtctggcgttagcacctcgtccactagaataatttcattggtcttttcgtcaataccgaattcgaatttagtgtctgcgatgatgatgcccttctccttagcataatctttgcacttggagtacagttttacagccagttctgccactctacgtgacaaatcttcacccaccagc

SEQ ID NO: 14425 - DNA, 430 bp, Saccharomyces cerevisiae
gggtactacaaatcgaagtaacagtgataaaattgctaagcacatatatttctataaataattcaaggaaaagaaaggtaacactacaatttttatgatgataaataatttgaataaaccggccagaataggccaaaaaattttttttaagtctaacgagattctcctccaaggcaataagaatcaataagtcttagtactgatggtagctccaatacaggcacattgaaccactctgtatgcctcttttttccagttggatcacacccataacagtaaaccaatcctttcccgtatttcttccataaaaatttatgaatagcgctttcgatatctggtagtttcattgaaccttttccgctaatgaaaaatccaccatctttataagtgcgtagggttggcaccttaggatctggaagggaaggcttgt

SEQ ID NO: 14426 - DNA, 454 bp, Saccharomyces cerevisiae
tagacgatatatgttgttgcttcataaagaatttatttggaatcgaggaacactattttgccattgtcgccattgacagcttgcagttgcaaacgtcttcttaattcactttatataaacaaggaccgccaggtcacagtattattcgcacgaaattatgtagtaggtaaaaaacactaaaagcattacccctatattgttatttaatgttccatctacgattagtaggtggtgagcatgtctgaatatacacaatttcatatttattatcaagttcaagattgccagaattttatttttttttccaatctgcgaataagcttgatccgattactccgcttaatgccccgacaacctgagaacttttaaacatatcaaggagtagagtgggattaatgacaatgtgatagtttcataattaaagtaagcagtcaaagacagaagcagcacacca

SEQ ID NO: 14427 - DNA, 479 bp, Saccharomyces cerevisiae
tttagttttgtgataattacagatttttatttagcagttcaaacttttctattcattactaacggactgtcaagtgcgatgctgtaccggaagtaaatgtatatactgattgttgaaaaaaaaaaaagctcagtcgcgcgtggcctttctctatggagatttctcaaacgatattaatcctgtatatctctattaatttagttaatacatacacgatatatcgtcgcttttatttttttttttcaaatacttcttcttcctaaaagagttaaaaactcttctcttgttttatgagccctaaaccctccaagcatacaagaagttaccgtagaagatcccgttttttgaatgcctcttgaaaccatgcacatatgagaagcttccataacaacggctacacctaatggttttagaatatcacttagggccattgcaatttgctttgtaagtctttcttgaacttggagccttctcgcata

SEQ ID NO: 14428 - DNA, 487 bp, Saccharomyces cerevisiae
acgcaaaacactgcaatattattctcaaccaaagtataactgtaatgaggcgaacaaacacatctatacatatatatacatctatatggatataaaaacgactaattcaacgttgtttttatcaaccgagcttactcttgtacgggtaaccgcaaggatagctagttgcggatggtatagcgatttggctggcacgatgattaaggaatccaaacatctaatggactagcacattctatcgatttacgggtcaggtaaacatagatattgggatatatcatatatccttactgagtaactataattatggttcatcgaggaaggactttgaagtcagacactgatgtaacatctcttaatgcgtcaacagtatcacaccagtcaaagccatttagacagttttcgactaggtcgagagcaaagagtaacgcaagcttcaaaggtttgcgtagagttttaacacatgatggcaccctggataatgatt

SEQ ID NO: 14429 - DNA, 456 bp, Saccharomyces cerevisiae
aggacagaatgaccacgtaaatgtatatatatacatattaatacttcatataaactaaccgatattggatttctcataataactattactagtataatctttaataatataaacaaatattacatttcatgtaatttttattaaacatatgcacatgctattgaaaattgctttagattcatcctatttcatcaacattcttaattttatgtaaactgtctcacttatttagagaaatagatactgagtttagcattacatccaagtagctttggtaatcactattatcagaagattttttcatactttgcttcatagtgtttataataaaatctttattttttaacagcgacttgcccacagggcctcctctattaacagatatatcaaagtcctttttgaaggcagatgaaactttgctccaaaacagatctctcggtgtaccagaacctgctt

SEQ ID NO: 14430 - DNA, 470 bp, Saccharomyces cerevisiae
aaaaagatatagcattcaatgaggctttattgaggggcacgatgctctttttttcttctgtactttataaataattccgtatttcttcgctttgtttcatgctctgttctgagcttttagtttctcttattgagagccttttccaaatcaaggctcaggaagtgactcgtccttagaagaacaaggtttggatttggtagggttcttgtacgaagttctcaatataatttgcgcatttactgtacggttcatactagtttattccgggtaacaagttttcttgtgatgctaaatcaatgtgtatattgagaaaactatgtagtaagttacacaaagcaacaaaggatattattatatgtgacagagaagaattgctgtagagattcatgacaatatgaatgagactactacaaaacagccgctaaagaaaaggtccctgagcagctatctttcaaacgtgagcacgagac

SEQ ID NO: 14431 - DNA, 487 bp, Saccharomyces cerevisiae
tatagaatcaataacaaatatataaacacaacctgtcatttagcacgtttttttgcccgatgctcatcgcaaaaatttttcgcttgaagaaaaatttttcacttttcttctttttgggcatataaagaagcgtagaatatataaaagatatttactacttgttagtactttcccttaagtgttaactttgaagatctgttgacttgcagcaaaaccactaaatatcaggggaggaataatacaatgggtactggtaagaaagagaaatctagacgtattcgtgaaggtgacaccaaagatggtaatcttcgtgtgaagggtgaaaatttctacagagactccaagagagtcaaattcctgaatatgtacactagtgggaaggagatcaggaataagaaaggtaatttaattagggccgcttctttccaggactccacaataccggatgcgagggtccaaccagatcgtcgttggttcggtaacacaa

SEQ ID NO: 14432 - DNA, 486 bp, Saccharomyces cerevisiae
gtgttttttatttgttgtatttttttttttttagagaaaatcctccaatatataaattaggaatcatagtttcatgattttctgttacacctaactttttgtgtggtgccctcctccttgtcaatattaatgttaaagtgcaattctttttccttatcacgttgagccattagtatcaatttgcttacctgtattcctttacatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggcct

SEQ ID NO: 14433 - DNA, 452 bp, Saccharomyces cerevisiae
atattttaatatttaacttagcttatgcatatatagttaaaagggataataacaataagaataaaaaacacaaactgctgagataagaaaaggaagcgaatagttaataatgcctgattcatcacattcaataagctcaaaagatgttgcatctgccatctctctctatgatcagtccatttacactaataacaggtctactaacctggacttagatcagagatcaatgagcccttccaatattgcctctggtgaagataggataacgagaacgaactcaggttgctccatcacatcaggtgcctccatgattgccacgaaggatggtattcaggggattaatgtcaaaagagatgggattccgaaatattcacttaatttattgaattccatggttcgaaaacaatatgatcacaataatggaacaaagtctcctaccccgaagactagca

SEQ ID NO: 14434 - DNA, 492 bp, Saccharomyces cerevisiae
actcagctggtgctcacataataaataattgaataaataaggcaaattaaataaaaaaataattcaagaatgggaagtgtatctcctttaaagatacttacacgagttgaattaagcttcatgttttgactttaatgtcttctgcggttcttgtccgtatttctgtcttcgtgatgtatttgttcttttttactgacaccgtgacgcgaggaaagctcatcaaaataatggcaaaatgcataatacattattacagaattgagcagaatgactgggaaaggtggacttgacaatgcgccaggtactacaaaaagataaaagggatgtacagctttccaaagctttatcatatctgcttcgacatacagcggtgaaagaaaagttgactattgactcaaacggttatacaccgctgaaagaactattgtctcataatagattgaaaactcataaatgtacggtggatgatatccatcgcattgttaaggaaaa

SEQ ID NO: 14435 - DNA, 454 bp, Saccharomyces cerevisiae
cggcatagatgaagagcccggccaaacaaacattacacatgtaatcgtacatatttacatagaaccgtacacgcttttagccaaaaaaaaaagaaaggtagaatataaaataaaaactcgtatttcgtattaagacaaatatacagaaatacaaatgagatcataaacgaactaaaataggaaaatgaaaaaaaaaaaaaaagattagcgaaggcaaaccagaaagcagtcctttgatataacagagaaaaagaagattatcaaagccttaatttaaagttaaaaatattgggtatcgttttttaaatcaagattttttttgtttttttttacaattgagtagacttattcattggatagaataccccagtatttttcaacaccgtaagcaccgtcggccttccagtagtcgttgaaggcagtgaataagaaggtatcagcaccacaggagctg

SEQ ID NO: 14436 - DNA, 424 bp, Saccharomyces cerevisiae
tgaagaaatcttgtgcatctacattatataacgaaatttttacatacattttcgccgctatttttcttcttatctcaaaatgaaattaccgtttgcaatcaacaccggtcgctgttttattttgttcataataataatttagatacagcatgaactgtatattaaagtcaacgatttcaacaattcatttctgtgtaactatttttccaatagaaccactgtctttatggagtagttgggctctataaaaattatttagttccaaagtttgtttatattttgtttctataataatgtattgaagatataaacaaacataattttactgttaacatttaggcgcaacaaaaggacgatctttttttatttatcacaagttaaagattttcgatacaaataatattgtggtttaaggtacgtccaa

SEQ ID NO: 14437 - DNA, 494 bp, Saccharomyces cerevisiae
aaaacagcataaatagtgtttcttcaatagttaatcgataatcaattactattatactttcatacgaatggggtgttacttttaaggacgacatataagcaatggaacgaccagttaagataaatgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgca

SEQ ID NO: 14438 - DNA, 495 bp, Saccharomyces cerevisiae
aacgagccgatgagatttttgtgtacatactataaataaatgcaactaataaagtcatgattaatcagtcatgcatacttcatctgaccaatatattttcatcttgcttattttgggtataattcggcggaaattcggttataaagcgaagtgaaaaatcgattagtaatgatactgatgcgatctctgggaggggggaatgctgcatataagggtgaaggaagataatgcaaagccttttgtagtattgtctgttgataccaaaataaattagttcatcaaaaaggtacaggcagctaaagaaaagctgtaaatttaacgccgtagaaggtatttttcgtgagatctatctcaaggcatcattttttttattttcgcaccaagataggaagaaaaagagtcacagtatagaggactaaccgttaaagattctaaatcggtactgtaaatactttgaaatgcctcaatctactccaagtcaagaagtacagcgtg

SEQ ID NO: 14439 - DNA, 474 bp, Saccharomyces cerevisiae
caggagagctgaatacccgagtatttagaactatgtatagatatagattttttttttgggagcaaagtcatctcagtcatcgccggtagttgcgctttcttctcaacaaaaaagtacactgctcgtggtagaaaggtaccttgaaaaattaaagatcacattgctactgttagagcttcaatcgctaaagtaaacatttgaaaaatgcatatccgaaaggaccaaaccagcaaaaggtatataattcattcaatagatacaactgctccatgaaaggaaaaaccttcatttacggtcgcgttttttttcgtgatataaaaaaggtaaaaaaaacgcgtcgcgttagaaaaaaggtgtgtgtgaagagaaagacccattgaatggagagttcggttcttgggaattgcactgagccgtggtgagtttgttgctttactacatctcttcttttataagcaacgcttaagctgaacc

SEQ ID NO: 14440 - DNA, 401 bp, Saccharomyces cerevisiae
gtaactaatttttctattttttctggataagtataatgagtaagaaaggaaacagagtcaatgttaaaaaatataaataattccaagtcaaagatgatagccctttggtatcaaagcataaacattgcgcgcaatgtatgtatggccaaggagctacataaaacgcttcgctcttaattagtaaatataataatatttttttatttaattatacattaaagaataaacaaaaattaaaaaagaaaaggcaaatattttgaatagtaaattattttaaatagctttctaatttaattttaaactctctttctgtaacgtctgtctctttgggcagaaacgttgataacagataatggcaacttcaaacccaaagatttaaccaagtcagaagtttggttgtc

SEQ ID NO: 14441 - DNA, 408 bp, Saccharomyces cerevisiae
tcgatttattacgatctccacaaatccaaagtttgtatacatcacgatttttttactacatatatatttccttttctattctatttgtaaatgggaggaaatcttaatatggacctctcttcacaaattgttctataatacaatatatatcaagatataataacaagtcatttgagataatggtatgcaaatacgcgaaataagagtaaacggatacagtgagcctgaagaggacaagctgcttccatgttgtagtgtttagatatatgagcttaaaatttagatttactgaatattatacaatagtaattatacataaagaaattccattttatctgttcgatagcaatggaagaggagagagttctgtgaaacaaataacagcagcacagaaaactcccgtcaacg

SEQ ID NO: 14442 - DNA, 481 bp, Saccharomyces cerevisiae
agaagtaaacagttctttgctatttcacacttcctggttgatggtcacttgctgcctgaaatatatatatatgtatgacatatgtacttgttttcttttttgtgcctttgttacgtctatattcattgaaactgattattcgattttcttcttgctgaccgcttctagaggcatcgcacagttttagcgaggaaaactcttcaatagttttgccagcggaattccacttgcaattacataaaaaattccggcggtttttcgcgtgtgactcaatgtcgaaatacctgcctaatgaacatgaacatcgcccaaatgtatttgaagacccgctgggagaagttcaagatatataagtaacaagcagccaatagtataaaaaaaaatctgagtttattacctttcctggaatttcagtgaaaaactgctaattatagagagatatcacagagttactcactaatgactaacgaaaaggtctgga

SEQ ID NO: 14443 - DNA, 487 bp, Saccharomyces cerevisiae
taagcttataccccttcctttggacaagttttttccctcataattacgtctatattttataaatatcattgtagtattcgcattgtttaagtggttaccatttgaaacgactcatacagacaagcggttacagatgaagctttctgaaggcacagatcagaagtattttaatgtcggttgtctattagtggaaccaaagtgactacacacctcctctgtctggaagaaataaattcttagggtcgactccaccatttcaactttagtataatatgacaataaaacattattgggactgagaacgattatattaaaattagtaaaatacatacataactacttataaaaaaaaaaagagaaatttgccattttcacgagtataagcacagattgtacgaaactatttcatatagcttgttttagttattatcctataaaatcttaaaatacattaatctagaatccaaacggatttgatgcagtagca

SEQ ID NO: 14444 - DNA, 431 bp, Saccharomyces cerevisiae
gaaaattaacagttgtggaaaaggagcttaaaagtaacaagaaacaaaatagcagtcatgccatctttacttcaagatagtttttgacttgtatttgtatttccgttatgcgttttttactttaaatataaagcagtattgaaattatgtaagtagtgttaactataaattatttctttaggactttaacttcgcaaaattatgctattcatattatcgatttacttctttgctgtcttggtgtgatgcttttattaataaggaggatcttgccgtacctagggttggcaaacgtttttctagttgtttttgaatgggcgcttcataatgtggcaatgaaaaaaaaaaaactagaaaaaaactgcaatgatcttgacgatgacatgaagcctccttttaacaaaatccattgaggtcaacaagcatcacca

SEQ ID NO: 14445 - DNA, 461 bp, Saccharomyces cerevisiae
taaatctttcggaactctttgtagttacatggttttttctttatgatgtgtgatgttccttaatattatattcaatgaatagcagagtaataaaaaaattctaaaaaaaaaacgcttaaatcgaggtggaatatataaacttaagtacgcatatactctagttcagtttaaaaattagctgtttttttaaaaaaaaaaattctctttctttacaaaatgttcttaaatgtatgtatgtgtgtgtgtgtgtgtgtgcgtattgttctatttcactccagcttaaacatggcggttgcttcttcgtcatcaatttccgcgcgttcgattttatttaaaagtactttctttgaagcgccgagatttttcatgaaatccgtctcaaatccaagcaaattatctttgaatttctttctctttttaccgcgaatcccaagcactgacgctacggggatgtcttcaaa

SEQ ID NO: 14446 - DNA, 498 bp, Saccharomyces cerevisiae
ggatataaataattgccatagactttctacggaagaaaaaccatataatcagattttaaataaaattttccgaacttttatactccacggttttggagttgtttgattgcagtgacaagcagtgcgccattaacactatccatctttcgtacaaagtaaagataaagttattttcctgaggtgagaaccgtaaatctttatagacaaggagtatttataactaaactattaccttgttacttatggaattaatcttgactaataggcagatgatcaacagttattgattttgagtgaaagtccataaagttacagtatgtaattacagtacgtaattaaggaatgtctgtaaatatatgctcctttttttttttccacttactatgattttagtaaagcaccatgatgatgtagatgcgtaatactctataaatgtaacatcgttaaagcattggttattttaatttcattctataaaccaatatttctgacagcaca

SEQ ID NO: 14447 - DNA, 470 bp, Saccharomyces cerevisiae
aagcagtaaactgagcgaaataatattcagttgataatgcgtttattaagaaaagaaaaagagtaaaaaaataatttgctattttgatctagtaaagacaaatacaaagatgcttacgctcaattcctttatttttttatatttatgtagctttttgtatattcttaaggacttgtttgatcttttaccccttcgcgtggagataggctgcgcggttacttttattagaacgtaccccagatctgtccgtcgaaggttaaagaaatgaacaaacaaccctacgtacgactgtgttttgcagtttaagaaggatgaagcattcccaaaaataccgtaggtatggaatttatgaaaagactggtaatccctttataaaagggttgcaaaggctgcttatcgcttgcttgttcatttcaggctcgctgagtattgtcgtttttcagatctgtctacaggtgcttctcccttgg

SEQ ID NO: 14448 - DNA, 404 bp, Saccharomyces cerevisiae
gtgtggtaaaaaaaaaaaaaaagaaaagaaaagaaagcaggcctagttgttaatatgtatactttttattcattcaagtgtacatatgtgtatgtatgtatatatttgaactagtatcaattttttaaaagttcttgacattctgccaaacttttcttagcgaagtattttacatcaacatcttcgtcttgacacagcgtttgcaatgagggtaaaattgtgttcttaattaatgcatcatatttggcctcgtccttaattaaaaccttcactatcacagcgtaggatttggccacattaaacctaatatttggaacaccgtcatcagccaagtgagaaatgaatggtaatagttgctcagtaacgacatctaacgataccacgggcaccaaagtggttagagc

SEQ ID NO: 14449 - DNA, 427 bp, Saccharomyces cerevisiae
gttaagcacgatttagaaggtggcgagcctcaaagtgtaaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgatgaacgattagtactcaaagaacactttaatccttggaaacaaaaaaataaaaaatcaaaagttgaaggaaggtcaaattttcttcctccaacg

SEQ ID NO: 14450 - DNA, 474 bp, Saccharomyces cerevisiae
aagagttggagggcttcttccttcgaataagaggtcatatttacctatgtaaaattgtaaccatctatgttcacacataaattatattttatacattattagaagtgaagctgttgtgtcgtgaaaattttacaaatccgtcatttcatatttaagttttccaacaagtgctagaaaacctaggggttgttgaaattggttaaacaaggcatcttattatacatacaacagcataacgctagaggggcaagaaggaagaacttaaaataataggtgtaaaatgactttggcttttaatatgcaacggttggtgtttcgtaatttgaatgttgggaagcgcatgttcaagaacgtccccttatggaggtttaatgtcgccaataaattaggaaagcccttaactcgctctgtagggttaggcggtgctggcatagttgctggtggcttttacttgatgaatcgccagccttctaa

SEQ ID NO: 14451 - DNA, 448 bp, Saccharomyces cerevisiae
agagattaaactttcagaacattcatgtatatatgtgtatatctgatatgtattattgcatttttgctgtagtactacggaaaagacatttcaataatctatacatcccgcacataaaggaagattttcgggtaatatactattataaaaattatcgatgagctctgtgaaaaggtcgtaaatataaaagttctttcttgcgacagtggcaacaaccaagtgaaacagcgtgagacgagactgctctaatctatttgcagtcgtaggcattacaaatgaccgaacatgagtctttaggcctggagcaaaatcaagacggcggtgacacttatagacatcacaacctaagcgatgggtgtatttcgagtgttgaagacgccaacgagcagcctagttcgtatgaagaggaaagtgatgatgatatgcaatattacgaacgtgcgatcca

SEQ ID NO: 14452 - DNA, 408 bp, Saccharomyces cerevisiae
ttttcatgagctctcttatcaattatgtaagtgcttgtatactatttacctaagataagaaaaaaaaaagcaattcaaaattaagcttatcttgacagcggggctggtttgtttctagaagacaaaaagtggggaatcatttttacgtaactccccctgataagaaggactcacatccttataggtacgataaagaatggttgtatctttcctatttttcgaaatcgttatcttatatagttgaactactacggttaaaaagcttaagcctcagccctcttagtcaaacttcttttttgaaggcaccagggtgcataaaagtgcgtctattgtttcccagtggaactctgttgagatagcgatgtttgtttttttttcacttaacggcaaccaataccgatagcgacg

SEQ ID NO: 14453 - DNA, 479 bp, Saccharomyces cerevisiae
gctgctgttattgttgttagtatttcttatatatattaaaaatctctcagttgattttccgtgaattgtttaggaaaagaacaaaatttaaaattaaacagctaaaatcacatcacgtattcgcgcctgcgacatatgtacaagaacactataacttattatatagaagaggttttgaacacttgtaggccattagcgcagtacccttttttaccacatttatatggccggagttaacgccggtccggccgaaaggtgttcaataccctatcgtatgacgagcaatgccgttatgactagtggacatgcttggcatggtctattactcaagattttctgtatccttcttacgtgtgaatttccacgagttgacaacttttgaaccccttcggttcgttactattggagttttactgcccatcataaatttcgccggcctataaaagactaagggaaaaaggaagaattgctgggtttga

SEQ ID NO: 14454 - DNA, 427 bp, Saccharomyces cerevisiae
tgaaccaaatgtcttgtagtgcatgctgtttctgactttgcttaatggatttttttagttcgacgatgttccgtatattttagaggcacacactttcacttttcctatgttgagtaatgaaggcatttgaagttacggaaccttataggtgtcagcacgctgtcattccagataattttgtgtctcccttacctccacatatgaatttggaataccaataattacctcttaaaaggtttcagaagacgtttactatttaattcttagctacacatcatatagttattaattcaatatattacttttggtactgcattctaaaacactaaagtataacctccgaacattatataggtgtttattgagttattttttgaagaaatagtccactagaaattgcttgggatgcgggattcctttttctctt

SEQ ID NO: 14455 - DNA, 467 bp, Saccharomyces cerevisiae
agggattaattaaatcgtaaggaaaaataaaataatagtgctgtgatcgcatgatattcttccctggaagcgccattttatagcaagaaatgtaagtcaagtatattttaactgtatatcaacaatatagctcttttttatgccttgttgtttttcttcgggttttccccacacattgtgtggagagatagttattaacagaccggaaaatagccgcccaaggataaacttttatataaagggaagggtagttgacccaaaaaatttggattctacttttccagatttactttcacccttttatatttgctgtagtctgttatgccaatcaggaaagcatttgaacaaatatgtctgttacaggaactgagatcgatagtgatacagcaaaaaatattcttagtgtagatgaattacagaactatggtattaatgcctcagatcttcaaaaattgaagtctggtggg

SEQ ID NO: 14456 - DNA, 493 bp, Saccharomyces cerevisiae
aaaatatacctccgatatgaaacgtgcagtacttaacttttatttacctttataaacaaattgggaaagcaaggagatagatctgactgccggccgagcttggcttgacttagtagtttcgatgtcccttttcttactttcctcatgcaaaattggtgatgaattgaatgattttcgttcatctacgcttttcatgtcaatcacaattctctgtgacctggcaccaataaggctttttcgcagtgatggcctttgcgtgatttgatttttaccatcgttatcgtcgcaatcatcatctctattttgattgacgtataccattcctctacttttttgattaacgtgccgaggaaatagtggttgtctatttgcattaactccgctgaatgaagatgaatatctaaacttttgtaaaacttttgtgcaccccgatatactcctctgggatgacccgggaaatgaggtggtgctgctcgtgggaactcttgattcc

SEQ ID NO: 14457 - DNA, 426 bp, Saccharomyces cerevisiae
actagtctttgctctctcaatttttgttaattatttacatgattttttgatatatatgcagttgattatacaatatgatatatgcatttctagaatttactcacaggtaatactctcttagatttcctcagttctttaaaatatgaaagatgtctcatttcaatctgttcccatttattgatcttgcttcttggcattaataagtaatctttcataaaatacttgtaatttgatatgaagtcacgtacctgatcttctaaagtttttaaatcatcaataccgtccaaatatgtgtctaactgcctcattatactgttatatgtatcgctttttaagtatagtctgggctgaaatttattgggctctttttccttcatttttaatgttggccaagatttatcactggactgcgtcttatcctcggat

SEQ ID NO: 14458 - DNA, 495 bp, Saccharomyces cerevisiae
gtttgagccaagccacgcgacgctccatactgtatagacctttattataaaaacatctatttctttatatgtccctctatcttatttttcttttacttttatttgtataatacgcgaaaaattatagaatcatttattatcaaaaacaatcaactatgaaatgaaaaacaatacgcctgctaatacggttcgcccttcaatttttgttttttttacatgaatgagtcttatactagatgatatcatcctctcactaacgaatgctaacgaacgaacgccaccacaggcccttaaaaccactttaagcctgctatacgaaaaatcaaaacaatatggtctttcttcgccgcaactacaagcacttgtaaggttactctgtgaaacttccataatagacacagttacaaaagtgtacatcgtcgaaaattgctttttacctgatggctacttgacgaaggaacttcttttggagattattaaccatctcggtacgcc

SEQ ID NO: 14459 - DNA, 600 bp, Saccharomyces cerevisiae
caagcatgccttttcaatttatagatcgtgtagtttattagatgcgaatagcctaaacaaggtcgcttattattattattacaactattctttttcctattcccctctggttaacaaaaaccagtatattaacagaaataaataataataacaaaaaaatatgaatataagaataaattgcaataaatagtaatatttataaaatataaaaagaagaaatttttattctttttatattttattataaaatagttcaattatttatattatttaaatgttgtaatttattattaataattatattttatcaatatttatacgatataaaaatttaaaaaaattataatatagaaataataaataataataatatgataataaaataatatataaataaaaatgataagattatattaatttatttaattttcaaattattaaataaataataacctaatacttacttttcctaatattattaaaaatggttattgtcaaacccattaactgattatattataatatttcaatatttaattcacttaatttgttgttataataattaatgaaatagagaaactataatccaattgattgtgc

SEQ ID NO: 14460 - DNA, 433 bp, Saccharomyces cerevisiae
agaaggaagaagacgcacgatatatatacgaccctatatatatatataatatgatattcttttatgaacaaactttcttttttttttcttcgttcaattattgactatttttctatcatttgctatggggaaagggctccttcttactgaaaacgatgcagcggttggagtgagaaagataagcacgcaaaagcccacttgctatagcacttgctagacggcattctagggcatccaactgctcctcttcgtcctcattggcagaactatcgtgttgttttgttgccagaagaattttcaagggcatgatacttttccgatcattcccccattgccaacatcgttgtaccaaccgagtgaagaccacctctcgaagtaatgtgatgacgacatgcaatccttgcgaaaggaaaaatctttcatggcttgctgc

SEQ ID NO: 14461 - DNA, 478 bp, Saccharomyces cerevisiae
gaaatatttgaatagtttataaaaccctacctacttattttaatgacatacataatggtttttcatctttttccacaatgaatggtggttctattttttcttgtgtctttctgttgtaattccatttgtaaccgtgtccaaccaatgcgaatatactttctcgatgtcttctttgtcctccaattgatgaaatttggaagattcgattagcttctcattgcgagcattgcagacatcgtttgctagacataaatcacacctcttacccctggccatgcagatcaattgaccaaatccaaccaaaacggtgtttatttcgtaccacagtgagtgaggtagccaaacctgtaactcctttctagtatgctcggcagtcttacacttaatagggtctacccaattccacattttacacagcctatggacatgaacatcgacgcatatgccggcaatcagcccccaacctttttgcagtgtt

SEQ ID NO: 14462 - DNA, 444 bp, Saccharomyces cerevisiae
gagttgttctattcgtaagaactgtttatagaatactctttttttttatgttttgagcctacacctgttggtgtcggtaaagaaaaagtcagaaatataaatatttaatcggtatataaaaggcaaaacgtgaaaaaaaaaaattaaaagtttatactcctccttgtttaaagctcatcatgttcgatgaaaacaccagctgctacgtttgttacctccgattcagtattccctgtcgtttgtgatccagcttccccgatgtctctggttgtatgactagtgctttcatcatcatccatccttgcgttgtttatctgctcaactttgttatcatcatttaatgaggatttcaacttgttcatcaacgccagttcaaaatcattattcggttgatttctcatgttttcaaatattacttccatttcatgtggacttacgatttcg

SEQ ID NO: 14463 - DNA, 450 bp, Saccharomyces cerevisiae
taaattttgtattctttatttgctcaactataaccttgagctacaaaatatgagggttctattctatttaaaattgttaactgtatttactcttatttcatttcttttttagcatcttcaatagctttcgtaaatgagcggccttcttccttctgcttaaacttgacgatataagttacaagtttcccatcagccgcaacagtaggagctttaatgagattatcatttccgggagctaaaggctcatatttgaaggagtctacaacagttgcatttagtaatacattacccataccgtcagacctacaaagtaggcgcactttagaaggatcgtcctttttcttcaaaagcttcatttcgcctacgcctcttgaatcgtacgatttggtttcagcattgaatgtcattaattttgctttttgcgaaaataaagccacttcgtcttcctca

SEQ ID NO: 14464 - DNA, 401 bp, Saccharomyces cerevisiae
tagcgcctcatgtgagcaggccattgtgggacagtatgaagggtatgatttctagataatccaataataattatgaagtttttgagatttggggtgatacacatctatgaattactaagagatttgagacacagcgacagtcatgccagcaagatttaagattttctttatttagtgtttatatacatatcagatatctgttgagtattttctattttaccaaaaaaaaaagatatgaaatcaagataaaacgtcgtatgaaagacaagggagctcagcagcaatatcataaagtaaagcaacagcgcttggttcatgtacaatgaacgatctgaaaattatttggcagcggtgctacgaatacatgtcgatattacgttacgattgtctaacaggggagg

SEQ ID NO: 14465 - DNA, 477 bp, Saccharomyces cerevisiae
taattagtcaaggttttttttttcttatttttttctatttcataacttagtcatatcaaaatatatctattaaattattttccatatatacgtagatattcttcatttgcataattctttgggaaaaaggaaaacagttatagaaaaatataaacaaaaaaccgcaacacttcatgattgcgtcgaacaatataccttaaagaagaaaaaaaaaggttggttttatcacttcattagtctatttgaataattcataaaatatttctgatttttttttttttttttttttttcatattattttaaacgtgactttggctgcgattcatggtttttgcccttatatcttcgttgtcattattatcagcattattaggataatcctttccatgtaatagaaaacttttatttttcaacatggataacttttcgtccactttatctatttcaaaaatttgccttggtgtagccgctgactt

SEQ ID NO: 14466 - DNA, 404 bp, Saccharomyces cerevisiae
tataggaaatagaagagaaggagcgacattatgctgtttcttacagatttcataagagactagattttaagtatatttaggatatataagaaaggcgaaatttgtaaaaaaagaacaggaggaaaaaagggagtacactttaaaaaggagcacataaatgcacaatatgtttccagcactcacaaagacactgtcgttgcaaggctacaagattatcaactctcaaacagggtccgctgcatggtcgtgcggtcgtaggtggtttagtagtgataaagatgaccacgacgatgtggtgacgaggattaaaattgcccccataaagagaactaacgagccattggataagaaaagagctcggttgatatatcaatcacgcaaaagagggatcttggagacggact

SEQ ID NO: 14467 - DNA, 433 bp, Saccharomyces cerevisiae
tttgtcagcctcccgaagatgaagatatcttaaattggcttgaaacgaacgcaccacgaagtcagtggttctttgtattagtaaataaaccaaatataattttgtaccttagcagctctttcgagaaattcattttcagtttagtaggcctgactgacaagcaaattgttcttttttctggacggtgcgggatcaggggaatcacacgttcaataaataaagaaaggatgaaacagtcgtacaacaaccaaacatgaaggaggtacagaggaagcaaacaaaaccaaatttgctaaaatcaagactggggcaatttttcagtccgtatacaatcgttcacaggaattagccaatatggatgttacatttctaaccaaaaatgttcaaataaatggcactcagtttaaaatattacttcaaaatgggcaaggtg

SEQ ID NO: 14468 - DNA, 437 bp, Saccharomyces cerevisiae
aaataatattccacttttgttcaaggaatatcccacctctattttatttttctcttctattctttgtcgagtatcatcaagttatcctttgattattttcacccttcctaatctacctctctttgtaaccgttttatgtaccaatatttactcaatcaacaatttatcaaccagttagttattctctagtgtttcgtgctcaaataaccgagtaagatggactctcttctgaagcacttttgcgggcatttaacctcagctcgtcacgtgacggtcgatgaaaaatccagggtattaaaactttcctttggttatatcggtatattctaaataaaagagaagcttattctgatccttttgattccctgctcaatttttcattgaattgtttatttttgtcattaatgaagctttcaaccccatacagtgtttttgca

SEQ ID NO: 14469 - DNA, 443 bp, Saccharomyces cerevisiae
tgaagccattaaatgaactaaactttagataaattttgacaacacagaatagaaatcaatagtattatatagacaaaacggatctttttattatgaacattgtgaattattaattatatttttgagtatgtattgaccaagaaacctcaataaaaatgaggtgaaacctagggagacagaaactcccatttcaaaaaccttcaactttcattataagcttaccttgagcacgttgtgtagccatataggaaaatgcttccttgaaatttttccaggaataaaccttatcaacaacgcaatctacgactccctcatttagcagcttgccgcattcatgtatccaatcattcttcttggggataatcttgatattggggtcaaagtaaaaatgagaataatcgtatgaccataacattgatccaaacatttttcttgcattggcg

SEQ ID NO: 14470 - DNA, 447 bp, Saccharomyces cerevisiae
gaaatcaattgacaccgataattaattttatgtacatgaatgtgtaatatttactgtttgttatttcacttgtaaacttttttgatttgaacttcaatctatccagtaacggtgtggtgtatacttattttttccttttcttctctgccggaatttcataaaatttttactgttcagcgttctttacatatttatataatagaatatgtcatataaagaaacagtgacttagtttctgttttactttttttctcctatttctaccgtgattttgattagttttttctttaattgttgctattcactgtgcttgtgttaaatcttgatgatggtacttgaaccctctgaataatgataatatacctctttacagtaactatctttctttattgggtgctttttaaatagttccactatttccatcatactcattctcacgcttcagct

SEQ ID NO: 14471 - DNA, 486 bp, Saccharomyces cerevisiae
tacgtcttacgactatgtttagctttgatgttttctccattttttttatgtttttttatgataatctctcagccgccatcacttccacacaggcaatgctctacagttttattttgcttttaggtaatgccgcatatatatatatatataagttagaacacaaactatagagcagcgaggacccgtagctaaaaggaagacaaattgaaaaatctttcacaaatgagtatagaatatatactttacacaaaacacataagtaaacaataacgtgataagaataggagagcaaatatgggaaagggcttatttcccccatatttggctgctttttaagaaaaagggaaaaagaatgatcataaagtaaatgaagtttcagtggtttaatcacttgatagaataccccagtatttttcaacaccgtattgcccatcatctttccatagatcattgaaggcggtaaataagtaagctgaagagccgcag

SEQ ID NO: 14472 - DNA, 448 bp, Saccharomyces cerevisiae
aaggcttaatttcgttagattatcattttaatatttgatttttggatatagtttaatttgtattttttaagaacaccaaacggcaatttattttattagtgatctactagctaaatcaatatactacattaaatttttatttgccatctttgtcataggatccgacgtcataatcagtcaggagccctacccctatacttcaatttgaaattaagaaaaaaaaagtgtagtagaacaggaaagtcgtattaatccatatgtagataaaggtatgctcttgtttatacaggccatatctacattgtgcatttcaagaacttattattttttgacaatttcgaccccccaatttaaagtcaagtggttagttttatcatcatcaatgaattttgatacggcactgtagttacctcttgctaaaaacccactaggtgcttcactttccggt

SEQ ID NO: 14473 - DNA, 442 bp, Saccharomyces cerevisiae
aacgaagtttgatagcaatgtctgcagagactttctccgcttgcataaccttataaacttataacgatacctacttatttcatatcttatgtatagttctccttcaaggagacgttgttttaatacttttatctattccatttatcattatctactttgtaatcaaagatcgaagcactgctgtgtgcgttgatttgggcctgacacgagaagaaagtgcgttacgtacatcaagattttattcaaaatccagcgtctcctccgcaaaaaagttcagaatacatttgaatgagtcctctggattctccaacagtaaattatgcccagtattaaattctcggacatcagcacagggaaagttatacctcaggagggaataatcattgttaataaagttagactgcaggcctttcatgaataaaactttacgactggctgtgcc

SEQ ID NO: 14474 - DNA, 476 bp, Saccharomyces cerevisiae
atattgatgttttgttgtgtaaatgttctatctgacacttaataattagaaaattaattttttaaactttccggctgcaagaaagaggaactgtgtctctttgaaaggcacaatttcccaaagaatcatttacaatggtaaatagcttactgcttagaaaataatagataattgaataaatttatagaggaatttcttgacaatttcttcaaaacagccggtaaaagtccattaaagattagtttttcttaaataaatcacctaaactttcaaatttagcataaaaaacatgtagatatttgttctctgtactttataatctaacattttataagacagagactagtaacccctctagcctgtggttaaaatacgcaaaacctttgaaccctcaatatttttgccataataatgacaactatattgtacccatttgttcttgagttgtccgtatggatggaaagcagcactcgagt

SEQ ID NO: 14475 - DNA, 457 bp, Saccharomyces cerevisiae
aaaagacacacatgcgagctttcgaacctcagatgctaatattacgtgttatatataccaaactttataaaatgacatagatattttatgctgtgatagctttcctgttatggagaagctcttcttattccccctgtcaactttcatactcttgtagaatttcctttatgataggtttatcgcttacgaatttagactttgatgtgatgggtttggcacctgttctttttccacaacctttgcgtgcctcatcaatagcgtttgatctgtcgggaaatttgtatttgtagagtgcatccttgcacattgtatagacccaattacgctcttctaacaggttcacgaacgattttatttcaggaacagagccgattgtactttttgaacctataatgatcagcttggatttggcccttgtcatggcaacattgactcttcttagctctttcagcagcgc

SEQ ID NO: 14476 - DNA, 492 bp, Saccharomyces cerevisiae
agaacattaaagtttttgtttgagcattactgtgatgccacaatttatatatcatacatgtttatatattctgaccaatacctttatttatggtgtgcagtgacacaaaataatttttggtgtcacttccatcgtattaaatgataatatcaattagaaatagtaaacaaaaccaaaaaaaaactaccaagggttgcaaagagtaatagtgatgtttatgtgaaggcaagcttaaagagaatttaagatctactatattaatagtaacctacaaaatttatagaagcctacttgacccagcccactgaagtctgaataggaatattgcagttgtttatagaagtagctttacaaccaaaataataaattgtttctgcaagaactggatgatctcaaaacaaacatgtcaacaaactcattccatgattatgtggatttaaaatcgagaactaatacacgacagttttcagatgacgaagagttcactacgcc

SEQ ID NO: 14477 - DNA, 465 bp, Saccharomyces cerevisiae
gccaggaaataacatacatatcctacgtaaactatcgaatataacttctttccgccagcattaaacgcatttatgttgattaattccgggttacgggaaaaatttttctttaatttcttttttttgaatttatttggcacgagaaaaggttcaaagtgaataattgcttttagtcattagacacattacctactttctaagagattctaaaagaaactaagcaccacaaatcattgatcttttaagaaaaacgcacaaggatcatatactagattctcgttctcgttttttcttccttttttttttctctaaagccttttactgggttaatttcctttattgacccaaattaaaagaaaacgtttctcaggagactcttttaagcaaaatttagcaaatttgtgtttgctgttgtttttacagagactgcattacttgaaggtttgcctttaagtcttcgagtcg

SEQ ID NO: 14478 - DNA, 473 bp, Saccharomyces cerevisiae
cggaaacgttagatttttaccatctatatagtatatataagtgaatcaggcagacgttccgtaatccttcttttcatgttttataggattacgtttataaaaagtattcacttttcttaagtgtcttttgcgccatcaaaaaaaaaaggattttgaggcaccggaaaaaaaagaacccctctccgaatgggagtatttaggacaagatttgtaaagtgctccctttttgagcaatactacagatctataatggggaacaaactcatacacgatggacaagtatttgaattcatttgttgaccacctttcagagtggtcatctcgtgcctttaggaacaattcatcaagcgctaaccaaagtgcgtcgaacaaggaattagaacaagtttttgaacagatcaatgctatagttgaaaaccacaataacaaattaaccactgcctttgataagatatcatatcgcgttgctcaca

SEQ ID NO: 14479 - DNA, 443 bp, Saccharomyces cerevisiae
tagtcctggaagttgagcttgcttatgtcaacgtcttccatccaacgagcttattagagaataaaaaaaaaaaaaaagaaataaaaatatatacttttctgtttgtcaaattcattttaacaattcatataatcaaatatgtgatttataataaccagacaaaagttaatcttgtacatttcagtataatatactatcaaaaaaaaatttgcgcttactaagcattttccccgtacaactagtacacagtgagaatggaagagggtaaaaattcattgttcggaaaaataatatattaaaggcaagccaaaaaaaaaaaatttagactaagaaaagaataaagatatctttgcaaggcagaaacccattcgatcagcacaaaaatgaccacgaacgatacatacgaggctacttatgccattcccatgcactgtgaaaattgc

SEQ ID NO: 14480 - DNA, 400 bp, Saccharomyces cerevisiae
atacgctgacacgtttgtactttctaaataaacctgtgtaatagtagtaacatttccagtaaaaatttcatttccttctctttttacatctctaggacaacgctttagtgagaaaaaaaaaaaaagaaaaaagaatgagaaaacgaaaattgaggttatgtgttgaataagcctagaaagcataaaggtgtcaaagaacgagtacacatatagtgagggggtcgtgatgcctttgttagataccttcaagagttttattcaatcaccgacggaatcaaaggtgaaacaggctaccaacgaggacgaaacaagtggagcaacggggacgcttatgaacgaaatatcaatcttgacctacagccccaagacagtacgagaaatcatccaggtaatccggaag

SEQ ID NO: 14481 - DNA, 495 bp, Saccharomyces cerevisiae
tgatgcagaacttatgaaagcttaacatttccataaatgaaaaatgaaaaaaatgaaagaaatgaaagaaaaaaaaaaaaggagacctttgttcatatgtgttttacctagattccctgatttttagggaatgaacaagcaacagagtcgtgtatgtaatctaccaaggaatttaagtaaaattcaccatatacatataaatataaaatacagttacaaagacatatactatctctctcacatgatctagctcgtttctagtggttaacagagatttcccaaacattctggtaggttgctaatatcaatgcttctttggaaccatttaagggcgatatccttgacgaattgatgatcttgtttgctaaagcaatccaaatttaacttggttaaaaatgaagctgcgatagtaatcggttgttctgaatcaatattttcacttttttgtatgacatccttcagatcgttgtacagatttgatgttctgcggtgaaa

SEQ ID NO: 14482 - DNA, 469 bp, Saccharomyces cerevisiae
tcgataacaagacttatcgcattataatgttaaatagatacataattaaaatcttgtcatttgtgacaaacgtttagcactgttcaaactccctggtatgaaaccacaaccgcagtgacctgaaaccaaactgagccctttggtagtctaaatggattattagaggggctatctgctacgaaatgttccaaagtgacaattctgcctacaaaccattctttccccttcgtcaatcctttttcgtcctttaaaaaatatcttgtgctttcttcaaaagctgtaaatgcagcccaaggcctcatcagtttattcttgtccctgccagatatactggcttgattgattacattactatgtatcaccgagggagacgattgtatagacatagcatccaaaggcggtggagttgataaatcaacagatgaaaatgatgagctcaatgatgaggtggaagacgacatagacccga

SEQ ID NO: 14483 - DNA, 401 bp, Saccharomyces cerevisiae
tacatttaaaaacgctatcttcatacatatatatatatatatatcttctttatcgctatcgccttatacatcgttagctaagcatcttcaattatgctaaacaatattcgaaaatgaaaatacatgtttctgtggtgacttaaaaaatccttaagcagagtaattcaaacggaagatatcgttaaacacgtagtaagagtttccatcaggaatcaaatggaacacttgagagaaacgctgtggattttgttcttcgtcaatcaacagatcaccagtgatcatgactaagacatcgccatttggggaagcaggttgcgcatccaaagtagtgatacgatgttggaccttttgaaatggcaaagatactaatttctcaacaatgtcctttgcaccttgcaatt

SEQ ID NO: 14484 - DNA, 453 bp, Saccharomyces cerevisiae
gtcgtttttctctttatatacttcattcatttgttctccattatggccaaacctttcataaattgaacgaagttctacctttggtgttgttatccctagaatttttttctaatgagtatgaatttaagtaacctttttttttctttttttttaaacagatatatcgtatatggaggataatagtacatcacttatgatatgagcgagaaaatctgtctttttagtaaaaaagtataaaaagtaaaaaggcgtcgattttgcgttgatttctttatatttacgtctgtacaaaaaatacattaagaatatattcaatatcttccctttcttcttccccagcaggctatacgctaatggattaaaaacctgccatatacgtggtatatcctgttgacgacatttatatgagctccggagtcaagattggtatccaccagttcctcaacgtcccta

SEQ ID NO: 14485 - DNA, 495 bp, Saccharomyces cerevisiae
acggacctattcattttacttactgtatagtatgtaataatataaaacaaaaatctcctaattcataaatcctgaggaacgtgacacataaagttattgtatacagatcatctaaagattggtttggtagaatgtctcccaaagctcgatgcattctttttgagattcaatggccgcttctagtgatatttccatgccgtttcggaattcccgaattttatcagtagagaaaccttggaattcatcttttattttatctcctaccgcttgccattgtttttttgtaaggttataccttctctccaatgtttgaaattcctttctcatttctctgaatttttctgaatgaatattttgacccaatttgcccaattgtgagtgtttcttattcatgtcattttctattactaccaagaaataccccaatttggatctctgattgaaaattgcttttacgcttgccaatgacctaatatagtcgtccagcatcacacc

SEQ ID NO: 14486 - DNA, 443 bp, Saccharomyces cerevisiae
accactgaaacttcatttactttatgatcattctttttccctttttcttaaaaagcagccaaatatgggggaaataagccctttcccatatttgctctcctattcttatcacgttattgtttacttatgtgttttgtgtaaagtatatattctatactcatttgtgaaagatttttcaatttgtcttccttttagctacgggtcctcgctgctctatagtttgtgttctaacttatatatatatatatatgcggcattacctaaaagcaaaataaaactgtagagcattgcctgtgtggaagtgatggcggctgagagattatcataaaaaaacataaaaaaaatggagaaaacatcaaagctaaacatagtcgtaagacgtatcagtttttaatgatcattggtctatcataggaagaatgcgatctcaatctatccggatg

SEQ ID NO: 14487 - DNA, 473 bp, Saccharomyces cerevisiae
atagccaattgaaataagtagacacaaaaaatagattaataacttatttattacgcgatacccgtaaatatgatacgaacatctaatttcatgtgaagcggcctagtgaatagaaggtttgcctattttcactcgttcactatacgtaacttggttgtctttttatgcaagctgtttgtccatcgtaccaacaccatctcatttcacatcttataaattagcctggccactaactgtcttacctcttatgccttattgcgtttttccaagcatctgctccatataataaatgtaactacctatcaaccaacttccatgtaccttacccaattggcctaccaagttttcgttacattgtttcgacatgatatctagttgttttgtcgtttcctgtaaattcgtttgaagctctctaagttcgtgtgcaagctgattatactgcctttgtttgttagcgttcattctcttgcctg

SEQ ID NO: 14488 - DNA, 443 bp, Saccharomyces cerevisiae
gtatttggctcaacagaaccggatcgatctctgaagaggctggtaacatgttcaaagaacctttattacaatgtgttatatatgtaagcatccactttaatgtatacgttttcccataatacttagtaaaacacagcttaatgcatttgttcatttctttttcctattttagatatattggattatacaatgaacattgtaacaactttattattattcaactttcataaggcatgaaggttgccgaaaaaaaattattaatggccagtttttcctcattcttcatcactccattcttcaaacgaatccagtataaagtctgtagcctcttcaaatctttcttcaattatattgtttaacccgtccgtatcacatctcaaaactctaccgaatttttttcttggttttctgctttcattttctttccagcattggtggctatt

SEQ ID NO: 14489 - DNA, 456 bp, Saccharomyces cerevisiae
agtttcaagctatatgcatttttttatataaagatttgtccaactttcacaactattttacagatacttacgctatataagaattagggaaaatgaaagttctttcatcaacatggcgacattcttccttctgtacttagtctgaatcagaatctgtgtcttttttgcttttacggttatgttttgaactattcgagacatatttactaaagatgtagaacctagcatcacgttctttcgcaggttttgtagtatcttgttcgctattcgttctccggtgatgatatcctggaaaattttcccattggaatttgctcgatctgctcagagttagtccattttttttggctaaaagtttgatttgccatgaatcatagggctctccatcgaaaagggacagtatgatgttaccataaccttcggcggtcaattttttagcctggggagtatcctcat

SEQ ID NO: 14490 - DNA, 485 bp, Saccharomyces cerevisiae
gtttaacatagagttcaacaacgttgttcagttgtagtatatattttactgtgaaatacgctcaaaaagtagcgggataaatcgtttcaggaagtataatttcttacaaaactataacaagatcgtctaagtaacatacataaagaaatcacataaatttttaaaattcgaggtcaaaaaaatcaggtggatacataacttaccttaagttatcaagattttcagtacacacaatgtgattacactgatttataaaaccaccttacggcctcttataagtaataacgtggctcatcaaaaacatggtagaagtgacccctctcaccttcgcctaaaaacttatctggaaatttcatgtcctcatattccggttcactcatatgaccgtattcatacatagaatccgagtgctctactaacgcttgctcactcaaaacttggaacttaccaacttgtagctccgtatcggttatcgttcctcttgc

SEQ ID NO: 14491 - DNA, 489 bp, Saccharomyces cerevisiae
aaaaagatcaacttattcacgattcatttattcatcatacttttcacttcaaaatacagttttgtagctatacatatgtaaagtaataatggtagaaaatgcagtttaccaaaaaaagttctaattatgacgaaatcttaaggaaagagtaaagcagggattatatgctgaaatttccactgtatatatttgccacagaaaaccattttttgtattaggtatatttagtgcacctttaacatgtcaataattcaacggaaaattaacgaagtaaataatacattaattaggaaaaatttacatgaaagtctataagctgtttataaaaaaaatatgcagggataagtgtctatcaaattgaagaatgccaattaattatgattatcgttctggtctctttttgttccctttttggctttgactgccaaggtgtttaaccaagactgtctttgttgtttcaataatctatcctccctccacttcatacca

SEQ ID NO: 14492 - DNA, 490 bp, Saccharomyces cerevisiae
ttctagaatatggatcaaatacgcttgtataaactaaatgaaacataaagattaagaacttaagaggccaacgtcgatggatttattgacgatcaccagccaacacatatagattttagtgtaaaagcaataaaaaccaagataataaaataaaaaaatactgaagaagcctaactagtataaactactttaactaataatggcaatttgatatagaaacaaagaaacatgatatatttaggatattatacaacgcattttcatttgttttacagcacccctgcgtgaatcatatattgacgtttcgctctcaggtccaccgtgttctcaaaagatacttttaaaacctaaaacacacgaaatcatattatgataattcagaatgatagtgtggtactgtgtcaattgactgttcaagactgaagaggatctttgatttgttgttactcaacaaataatcttcacgaaaactttctcaatctggggactg

SEQ ID NO: 14493 - DNA, 490 bp, Saccharomyces cerevisiae
ttttcatgaacgctttaaaaatactctttaaacaagaatggctttttccttctgtttaggtgaggaataagcaaaaagtaacaaaaaaaaatgttatcccttcttttcttccttatttaggctttattttatctttcacttcttttacgtatttgaaatatccttcggttttaggattttcacttctaagttttctattttatgccttccattttaaattcgtattttgtgtatactttattcagtaaacagacatcccaataagttctttgaatatcttctgaaaatgatgtataaatatatatttctagaatgaaaaaggaccgaaggcgttgtccagtttgcctcataaaaaatgaaatgttcttttcggaattttgagtatacaatgtgggtatgcaattatatctatctatggcacacataactttttctgcaagtcatagtagtgggttttcttttctagtactaatttgtaccatcggcaaca

SEQ ID NO: 14494 - DNA, 417 bp, Saccharomyces cerevisiae
ggattttgattaggcaactttaataaaaagtaaaacattttaattttttatatagtacatattttttgaggctttctctaccttcattaaatacagagaaaaggccggaaactaacccatgtatcagctctagaaccatggcatgaagttcacgtctgttcttgctaagtttcttggactgacagcgctgccaatacagtctaggatgaactgggttgtgactgtaggtgttgaattcaaatggcccaattgtgccacctttctaataattaggtcaacgttggtttgaaccatctcacgtaactgtggattttcaatgattggccggtgaaggttgctaaaccatgatatgatctcgtcacggatgaatagggccaagtatgtgttcagttcattatcaggttcaattaatgcacg

SEQ ID NO: 14495 - DNA, 401 bp, Saccharomyces cerevisiae
cattacctgtgaagaaatttcatgtatatacaatagatattcctaaattttcatatatgaatggctgctgcgcacatgtacttgcgaagagaagcatgggcactggcacttccgaatttaaagttatttcttggactttacaaatacctatgattgcaggtcttgtaagtgttgtgtaagtatttttatataccctttgtatatggtaattaagttttgtaagcagaggttattctcaagattagatactttttctgtcaactcgctaagcgtctttgtatattttgcagttaaggagaccaataattcttttaaaactgaagagatttttggcttgaagtaatcttctgatatgtaaccttcaatgaattttcgaaccctcctttcatccctcgtcacat

SEQ ID NO: 14496 - DNA, 494 bp, Saccharomyces cerevisiae
tgtgatcatattcaaagttgagcagacatatatagttattacatttcatacggttcacatgagttttattaagtaattacgttaagaaacaacatgataaaagtaatgatttcgtattgctttcctattttctgtatttaagcgaacaataataatgcaccttttcaatatctgaatattaaaatatcgtgaaattgggttcaggatgtaccaaacttgatgatagctgaagcaccataatcctatttaaagaagtacctgttatccgtcagtaattaccagaacaagttaattttaagtttaatctaaaaaagtattgcatgcggcattaaaagacaacataaaacatctaaacggtaaagtatgatcgataattctccataatagttctgttatttataatctccagcactaataaatgctatacgtatatttgtacacaatataatttcagaatttatattgctaccatgactgtctgagaattgggggaa

SEQ ID NO: 14497 - DNA, 475 bp, Saccharomyces cerevisiae
gacgcttgcagagttgtctaaatgactacttatttaaaattcactctttacgtttatacctatctatctatatataaaacccataaacttaatgctattcactgacaaaacgatacactaccgtctaagaagctattcacactagctcagttctaataacaatcatcgtctggctctaaaacgcgtaaaccattcactgccacactcactttagctctgttgctgcccttcatacgctgagacgcgacgcttcttttctttcatatgatttcccttctaggcgacacgccatgccccaaacggggaacaccgcgaattccttctggtgcccggtttcctctttgggaagggcgtcaaaatggtacagctcgctatagtcgccaattactgcagatgcttaaaggcttctgcaactgtatgtccaacctagtacgtggaaacttcaaacgcgaacaatctgtatgctgtttcgggc

SEQ ID NO: 14498 - DNA, 452 bp, Saccharomyces cerevisiae
cattacgttaataaataggtatatatgaatatttataccaacacatctattataataggcgaacctctgtatgtaattaagtaaaaaaaaaacgatgtgacaggatagttaaggtgcctcgtacataaataaaaacggaaatagttaattctttcaaaaatatggcaatagccaaactcattcagaaggtacaggaaacactctgtttctgtgcgtttatataaccatgcttataaaagaaagattgaacaaaatatacatgaatttatgaacggtaatcaccgttaattgttacatattcatgtgataaatcacaagtccaaaattgtgctgcctgatcaccggttcccaagtcgacagacacttccaaatcattcaaagccaatatttcagaagcccttgtttcatcgatctccaattgtggcacaccattagcgacaagcttcagctca

SEQ ID NO: 14499 - DNA, 447 bp, Saccharomyces cerevisiae
ccttttttacgtacttgtataccgtttaaaatttcctatgtactataaccttttttcactactattatggaattctatcgagcgaccgggcttttgttacggaagagtgaaaaaatcgagttttggtgttttggtgaaagaatttggaggactataaagtacctatactttgtattacggactcaataacaagtcgttcgtgtcagtggtattgaagttgtcagatctaagagtagagagaaggtggcatctaataggtttcgacgtttttctttttttaaggtttttatttggtctcctagaatttaaggtcttagttagttttggtttgttttgtgggttacatattttcaattcaaaggagaatttagctgtcttttataatgtccaatagagataacgagagcatgctgcgtactacatcaagcgataaggcgatcgctagtc

SEQ ID NO: 14500 - DNA, 450 bp, Saccharomyces cerevisiae
gatcttcctttttaatgaatatattttatcttatataacatatagaattctataattaatagagagtatgaagtacgattatccttaatgttaatcaaagtgaatcatgattgcgagagtaaggaaccataaaattaatcttcatctatgctaataatctcagaattctcgttcccagggtcttcttctttagatactaatctaactttcccgcccttttcaactgatatttcaaacccagctttgctcaatgcatcgtcttgaacaacgtcttgagcttccatttttttgacatattcctgattcttggcattattctttaacaaaaacttcaagcaaacaatagatctttccttgataaacggatcattatcatcgatgacacaattggaaagaattaatgcaagaccacctaattctcttatttgatcttggatttcaggatgtgca

SEQ ID NO: 14501 - DNA, 496 bp, Saccharomyces cerevisiae
tttttgggcgcaattaaccaagtccttttatttttttaatggtttatttatgaattgtttatgtttatgttctttatactcaaaatcaataagtgcttattttagcgaattttcttctacgaatatatataagtcatatctaagacttccatccgtgctttattacgtttgtatgatgcatacaatgatgccaaatcagcttgatgctgttggtattcagtcgtccgaaagcctgttgatgtgacactcaaatcttcggcatgtgtgaacggtggccgagcatagttcgtgaacatcatcacttaaaataagaactacactttacatcagcgtggaagataaaggttgttttaagctcaagggcgctggaggtgtagcgcttcggaggaaaataatattgaataacttcgctttttgttccaaattctagattatcgtgtatgttcttgttcgtacgtccatctccatagttataatgagtgggcatgattctgtt

SEQ ID NO: 14502 - DNA, 418 bp, Saccharomyces cerevisiae
tgatctagctttgatattcattcattatataattaacaaatacattatatacagggagtgacaacacaaaatatactcgtgcattgaagatgcttgatggatatatgtattacgacataaagcttagccattaagaatatgaacgtggctttaatttgtttatatgtggagagtataatcacttgccaaagatacaagaccaaagggacggattatgttgtacttttgcttgagaaaatgtgtgaattccacgtctatcgattttattaagcttccttgcagttttcgcgttgtttcttgtatgctggcccctaactggcagatgcaatgtatgtctcataccgctataactcccaatttttctttttagagctatattgtcttttacgattgctctagcgtctccttcaatcgtcat

SEQ ID NO: 14503 - DNA, 477 bp, Saccharomyces cerevisiae
ataaacgtctagatgccgcaacctatatacttttaccctactctatcggcatatatttaatctacgtattacatgtatccatcaataatatcatcataatatctggacacttttggaagacgcgcccttgcgaaagaaaaaaaaaaattttcgtttcacacctacagtaataaacacataataacaacgagctaatcatcccaatcaatcaccccttccccctttaattagcagccagggtactgtatttagtcatatagcggtacttgcattgaccgcgaacgtgtaaacacaagcaaagcagattatgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacga

SEQ ID NO: 14504 - DNA, 446 bp, Saccharomyces cerevisiae
aaaaacaaactttagtgcctgtaggtatttgtgtttataagtaaacaagttttgttgacttcctgaaacgtaaacaaaagaaaaattgaagtatgcctttttacgcttggaaaatagtgcgacaaagaactcccagggtttgctattcccatttagatgatgaaatgatagaaaagtggaaaacgtttatcatgaaatcatctatacatatacgtaaaaatgtaaactatgtaaaaatatgttccctataaaagtgatgctcttccggaacgttttctttttcccacaaatctcgttgaaacctgaaccaatctggtaattcagaatcacagggtatccttattttgacgttatcttttccccttgctttataatagccataatctccattttcttttttattaaatgctaatctatacctatggccaaaaattcctaggtcagaa

SEQ ID NO: 14505 - DNA, 491 bp, Saccharomyces cerevisiae
taaaggtaatgcacacgctcatgtgtagtttcttttttataatgtatattgaatagatcctttcagtcgggtaacaattcgatcccaaacgaatcgggccctaacgatatgtgtaaaaatggcaatgaatgaacaagaagttataacaacaatttcagccaagaacaagagcgatcctggaggagattatatacggatacacaggtacacaagatgacgcaattaaaatatttgttgctggtttctaggcaaggaaaaatcagattaaagaaatggtacacggcaatgtccgctggtgaaaaggcaaaaattgtgaaagacttgacacctacgatattagcaagaaaacccaaaatgtgtaacatcatcgagtataatgaccacaaagtagtatacaagcgatatgctagtctatattttattgttgggatgacgcccgatgttgacaatgaactgctgaccttggaaattatccatcggtttgtcgaaac

SEQ ID NO: 14506 - DNA, 446 bp, Saccharomyces cerevisiae
tcgaagtaatgtggaaatattgattcttatagtgttataagtgataatatacgtttatgtaaataatatctttttcacaacgttcaaaagtggccttttttcttttttcgatattctgtatatttattacgatttttttttttttcagatatttatttttgcaggttctctgaatggatgtagtgacaaaatcttaaatagaagaaaataaaagatgaaggtatatgaaaataaatgagaatgcatatcacctttccttcgaagaaaaaggattttcaaaagatctgcacgcctgttgacaagcttccaatagcatgaattcacaaaaggcgagtaaaatgactggctcactaaaaaagaatgatctttatatttttgatttgtctgagcaacttctgaattcattgaaattgatgagctttgactccacactgcgagaagttgaa

SEQ ID NO: 14507 - DNA, 407 bp, Saccharomyces cerevisiae
gcaatcgattctcatactgtcaactttttgaacatgattaaaagtttcctataaaatattaaaaagaaccaaaaaaaaaatggatagaagaatgcttgaggcaataataatgattatctattttatatatacatacataatcatttaagttttttttttaaagatatttcgatttagccgaatctgctcaatgcctcttcgatgacatccttgtggtcttctgaaattaggccttgtttgatttggtggtttcttttacgaatatttttctccttatccagttgtttctgtactcttaattttctttcatcaataacgttttgagtctttttacgcaaaaaggaacgcaaacccgaattcttacctttcacatcaggttttacatctggaatgtcgctgttggtttt

SEQ ID NO: 14508 - DNA, 450 bp, Saccharomyces cerevisiae
tgatacggattctctgtattctgtctatagtatttatataccaatacatttttccgcactttgaagttttgcattttacttaatgtagtttattattagttgccaaaacgaaacatttaacatgtgaattaaaaatacaaaaaaaagcctattaacgatctaaatttatgacaaaagacatataattattttaatgatgcctttgtcacaaccgaacacaatatctttgaaaagtgatccagcaatcgaattcagaattcgttgtgccatttttgccttacgtttgcgccattgtaatttctctgtgccgtcttctcttcactttatttcaatattatcatgcagtaaacaagttgcagaataataaataatatacgtaccaaatatgtgaacaactcagatactattcatttgatatgttaaaagtcctgcattcctctcccgacatta

SEQ ID NO: 14509 - DNA, 481 bp, Saccharomyces cerevisiae
gacaaataatcaaattgtatacaggaatatgtagatagtaataattattgcgatgcgtttttctatacgagatctaaaaggaaaaaagttcggttttaaggcggagttaacgtcatgtcgaatggaaagaaagattatataaagaatggaaaaacaaaaaaggtgaaaaaacatcttggaaggcctcataataaatcaatcggctgcctcgagaaatgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaacccttt

SEQ ID NO: 14510 - DNA, 498 bp, Saccharomyces cerevisiae
acatttgaagtttccatacttttgatacttttgaagttacttcgtttggtgttatggtcaccaacatcttttttttctccttctttcaaactcttttttaactccagaaaagaaattctttatttcacaaaaatttctccccacttttaatgtaatttttctttatataatatatatatatatatacatgagtatcaatacaatataacctaatctagctttttatccaatggacttgactatcatcagtactagaaagtgtcatttccatcagtacgcttttttggccgggttagctagtgctgacaaatagttgaaccttcttgaattatctaaatgtctcccaaatcaaccacatccatatacgatcctccaaaggtagcaaagtgccacttcaagcaattataggaagaaagcactactcctataaaatatggcacactatccaccttccaaggatcaattgaatgaattgatccaggaagttaaccaatgggc

SEQ ID NO: 14511 - DNA, 401 bp, Saccharomyces cerevisiae
atcatagtataaaaagaaatagaccaatatcaacatcaattttatgtattttttttttcttttggtatagcattgatatattgaaatttgtatatattgctgcgaacactatttaaaacaggttttttttttattttggcagtttgaaaccctttcctctgatgactttagtgtagtaaatgtaaaagaaatcagagtacaacagagtttgcaaaagtcccgcgaagaaggcaatcttgtccaattttttatcttccgtgctgtacctccaaatccagttaggaatatacaatgctctgtataatcccatggcaaaaatataatgaacagttagacttctagtcttcccacccttagatagcatgtacaattgaggtagaatagccacactctccaaccat

SEQ ID NO: 14512 - DNA, 478 bp, Saccharomyces cerevisiae
taataatattttgatttatcaagccgccattcacatatctacatattagaacaatccttttatttaaagtcgcgtaacttccttattattgatactgtatatggctaattgtatactacttattatttgatgaaaccgaaagcgtagcaacaggtatatattcattggcgtttgacttttttttttactgtatttttctttttcgttggcactttcgcaattttcaaggatgcattgaaggaaagagaaaagcgtaggagaacaagacgcatcgacggctacgggtgctttgagtatttaacttgcagagctccatatacagcacacatctgtagatgatttagtgacatattaataggctgcagaaagggagtaaaacaggtagaagtaagatatcggcaccattctacttttcatataacgattgattaatcttaccaaagcattaaatttaaacaggcttgcagactgaaggagt

SEQ ID NO: 14513 - DNA, 468 bp, Saccharomyces cerevisiae
taagctgcccgacctcacgaaatcagtcatgcggtagtccattataatataactattattattattactattactattattattattattattattatctattgtttatattctctttagctttttatcacctacgacgacggatatattcggcgtttgcaaaaagtgaaaaaggcgtcttttggtggacatgaactcaatcttcaattctttgaaagcggtgtatgcgtataaggccttttaaccatcgtgcaaaacaataaaagactaccaataaccgacgtgaatcatgtctgcaccaactccattagcagaggcctctcaaattcccactatcccggccctttctcctttgactgcgaagcaatccaaggggaatttcttctcctcaaacccaatatctagctttgttgtggatacgtacaaacaattgcattctcacagacaatctttggagctggtcaatcc

SEQ ID NO: 14514 - DNA, 471 bp, Saccharomyces cerevisiae
tagtttccttgagtgctttcaaataaaaacaaataacatatcaatgaatcaaagtaacatttctttgaagataatttctttgtctgtcactcagaatgccctttattactaacgaccatcctccttgatgaaggtgaaaatcaataaaattcaaattgtgacccaagtccagtcagtggatccttctggtaacacaagtattcggttttttttttttctccatgatctgtatgttttactaagctttgaatttttcttacacaatgtatatatatatatatgtgtgtgtatatcaaaacagcgcgcgtaattgtatgtagcatttagaatcaagttcaatgccgaaatttgttatggttgcctacgtttttttggcttcttaatttaatatcaaaatcttcacgatatgcattcattctcaagtttgtaattgtgcatttttttatatatagtcccgctctcaagtgaatt

SEQ ID NO: 14515 - DNA, 492 bp, Saccharomyces cerevisiae
acgtcaccccatcatcccacatcacaaatcccgatcaatttggtccaagtgtataacatagtctagttcagtattagtatagtatggcaatttatttgacataattacgtatttttcaggcaagctggcaggtgacccgccgcacctgcactttttagggagtcttttcaaggatatcatcactatatatcgaaggaaaagaggctttccaactcttttggatgatcgaattgccatcactactctattaactgtctgtgtattaactaaataatcacatagtattaagttataattcctggaaaaaaaaagaaagcgaaacgacaaaattagcatataccatgtctcaactgccaacagattttgcttcattgatcaagagattccaatttgttagtgtcctcgattccaaccctcaaaccaaagttatgtccttattgggaaccattgacaacaaggatgctattatcacggctgaaaagacgcactttc

SEQ ID NO: 14516 - DNA, 424 bp, Saccharomyces cerevisiae
aacgactagaaggttaggcggaaccttgtatatatttttgtaaaatcgaactgaatacagataattaaggcgcgcaagcaaaaacggcattctttatgaactctgcagaggtgccctttattacgacatatatgggaagtaatacatattgattctacaagaagttcaagccaaggtttagatatgagtgaccaaatcaacgttttgtcaatgcaacaacaacaacagcagcagcagcagcagcagcaagtatatatgtctcctcaagcagaaaacttgaatcatatgtacttgttagttaacaagctagtgaaacagttgagggaaaatcaagcagaaaaggcgaaaatactaaggaacatagacatattatccggaagcttaaacaagtatgagacatctgaagaacctcacgataccacgg

SEQ ID NO: 14517 - DNA, 418 bp, Saccharomyces cerevisiae
tacacagggcaaggtcattaaatagcgtatataatcatttaatatagtatgttctcgaagctgatcgcgtaaggcgcagagcgaactaaaaaaaataccggcacccatgcacctcacaccgccgcacgcgagtgaggttgaactgcacccggaaaatgccaagtagatgagtcgtgaagagttctcgttattcgagctagtgagagcctgagaagggcttgccgagtgaactggtgtcacattggccgttttaacgcaagttggcgtacttatattgactgttggatgaaagggtaatcaagagaaacggaaacggcctcctcatcgttaagctcatcagtattcatttctcccctttctgctccatcgcgtgctcgagactatattcttcagattatcaagcagaaacagaattcgc

SEQ ID NO: 14518 - DNA, 500 bp, Saccharomyces cerevisiae
ttcacatggtaaataacgacttttattaaacaacgtatgtaaaaacataacaagaatctacccatacaggccatttcgtaattcttctcttctaattggagtaaaaccatcaattaaagggtgtggagtagcatagtgaggggctgactgcattgacaaaaaaattgaaaaaaaaaaaaggaaaaggaaaggaaaaaaagacagccaagacttttagaacggataaggtgtaataaaatgtggggggatgcctgttctcgaaccatataaaatataccatgtggtttgagttgtggccggaactatacaaatagttatatgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatg

SEQ ID NO: 14519 - DNA, 406 bp, Saccharomyces cerevisiae
gtagtcacgcttattctgacgctattatatacaatgatatagaatccgaaattgtagtttaacactaaaaaaataatgcaatagaacaatagtgttgcgatgtctcctgacctcactatttctatagattggtatgaaaaatttttttttcaaatatatgggaaaaatttttcacggcatataaaagactaccatctttctgcatcagtgtgccagacccattctcacaccaagaagcgaggaagctaacaggccagtacttgcaggttaggttttcgtgctcagatgagcagatcatggactgcattgtgctgttgttgcacagtaaattttgtataccatactttatgatgatattctttacgaacttttagacgttagacttctgaaggagattagaccctcc

SEQ ID NO: 14520 - DNA, 451 bp, Saccharomyces cerevisiae
attgcgaacatcacttttcaaaaagcaaaattaaagaaaagaacgtaccataaacagatataaacatatatatgtataacaattagagtttctaatattttatgtttgctctggacgccagatgtaagaacaggaagggatgacgtaggaaccttgtgctagactaaagggtactctcatttatactttgtaatccagattcattatctaacgtattaatcagtactttctcgggtgaagaaagtcttgaaataaatctttcctcggaatcagaattcttagagctttccgttaatcctgagccctgtgtgaaaatgtcattattatgatctgattcggcagaattttgtgcattagctgcattcaagaaattctcgttacttcccaaaagtggagaaaactgattgttatcgttatcgttttgtaaaggatgccaagcagaggaatttct

SEQ ID NO: 14521 - DNA, 478 bp, Saccharomyces cerevisiae
tcttcgcacgataacgctaggccctattaaataattaaaaatacatcaccctatatatgataagaaagatggttttgtattattatgaaattgacttgaaagaatagtgtaacaaaagaaaaagaaactgtaattgaagaatgatatgcatttctatgtgtatattaacttaatcatctttatatccagaagacgcaaatgaccattcgacgtatttttcccatgcaggtttgttttcgtataatctgcctgcaagatccaaataacttcctactgttaacgaatccattgagtatggtttctcgtctgaggtatattctatctcatacctgaaaatatccttagattcaacaaatgaattatgtaattcttgattgattttttccaagtcggcgtagaattggacgaaacgcgtcggagtgaataactgcggtacatatgcagggccgagttcgtatttgtctggcatctcaattgg

SEQ ID NO: 14522 - DNA, 461 bp, Saccharomyces cerevisiae
agacatcgtagtaataaggtgcaagcttttgtatccttcttaatgatttgtaagcaaaaaaaaattacgtacatcaatttgtaatggaaaggaaataaatagtataatatgaacactctttctgagaacagttatctttagcttgccccacaaactgaaagcacatttttaaaatgttttacagatgaaaatgaacccttgtactgttatcctctgtaagtcgttatttttcttttgcctttttcaggttgactgctactgtaatcgtaagaatattcaaaatcaatcatctcgcatcgcaacaaaaataaaacgaagttactggtttaggtggcagaaacatataatattggcgaacattcataaaataattaaggcttaccaacgaagcataataaaattgccagtaaccaaaggtctctgataacatgaaagtggtaaagtttccatggttggctcac

SEQ ID NO: 14523 - DNA, 494 bp, Saccharomyces cerevisiae
taataaggaaaaagctaccacacaacgtctgtaatttgttgtcctttttttatttgtggaaaattcctcaatttgaaataagattcgtatttattttgtaaaacgattttagtttttattttttttttttcttcccttttaccttattatttgttttaccctttatggatattcatccactcagaaactaatatatcaaaatcaacgataagatcacaagaggtgaaataagaaaagtaaaagaaaaatatttaaatttaaccattatgatttccactttgttttctctactctattacttgaacaaactttatttttggtaatgagggctggtcacagattacctttaatatcctttgttagtagcttttttgtgttctatttcaggaaagaagaatgggaaaaataataaaacaataaataactatataaaaaacaaaaacctagaatataccattaaagaattactattctattctgtgcttcaccgttgc

SEQ ID NO: 14524 - DNA, 446 bp, Saccharomyces cerevisiae
actaggtgaaatatcggccctgtatattacgatacataagcttacatagtgataatctatctccgaatttccctaaaaaagaatgtcattttacgtattaatatgtaattttataatttcaacatttgtcatttttgtccctttgagtggtccatttcaggaagtatggaatcatcaactgatatggccgtcaacgatcaatcagtgagtttgtcatcaatggactccccttcgcctatacggtcggtgccgggtcctacaatgagcgggatcccgtttgcgttcatatctagaaaattgtttgtggtgtggcttgatatagcagctgttgctatcgcagaagtgttggaagatgatccgggcaccatcgctggaacagaaggaattgaagctgacgtgtttgacgctccctgctgggcggggacccttggtgaagggctgaaaag

SEQ ID NO: 14525 - DNA, 419 bp, Saccharomyces cerevisiae
tctgatgattagcttttacacacatatatactgctactatctttaaagcacaaaaaaaaaatctatcaaaaaggatcaacgcattactaaataaaatgtaacaaagaatagccttcaccctcagcggagaaattcttaacaaatcatccttggtaatttggaagtgtggtacaatccaaccaccactgcaaaataacatttccagctgctctgcttcctctcgtaataagtaatttattaataaatttttcatgacctgcaggattgttacatatttggggcaaaacagcaacgagccactctcttgcttcaattggaaacttggctaccaaagctcttagcagatctgtgtaactattcagatcggacctttgtgtgtggaataagccatacataatttggtacacaaggtctcctcc

SEQ ID NO: 14526 - DNA, 434 bp, Saccharomyces cerevisiae
aagagaaactaaaaagcatgaattgatatagttattatcatgtcgtctgttttactccatttcattgaggactctccttatgtatagttaaataatttcaatatcatctaaaatatgaaagatatgattcattattagggatgtattctcttaattataagcattttgttactgaatatagcacctttgatcaactttatgaagcgtttatataatattgagaatttcattagccaaagttttaactttcttaatttttccttctagttgttgaccctgttcttctagggcatctgccctatcattgattacagaaataatacccttaaatttgtagcttagttctattcgtttcttgattatttcttggtagagctggaactgttggtcaataatttcctggcccttgttagtccactcctccaatgtcgaat

SEQ ID NO: 14527 - DNA, 485 bp, Saccharomyces cerevisiae
taaatagtaaaataaagccctagcgttatagcgttttacactgatgaagaaatgtttctattctgacatcataaaatcattctcactgatgctattgtcacttttcatcacgtgtgtatttaagtagctcttacgtaattttgaaaaaaaaggaaaaaggaaactatatagcacgcaattccctatttggttgcaattcaattccgtgaaacccttttcttttctaaagtgataataaagtaactttgcaatataatcaggtcgcaaatatacccacagataataatctaccatgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcaggg

SEQ ID NO: 14528 - DNA, 496 bp, Saccharomyces cerevisiae
tgagagtaacattttgcttgctttttttctccgtttttgtttcttttactctgtatatagccctatataattacatcatttctctagcctaaatcttgttatatataccaagctttttggaaagctaaggataaaaacaattcttttcattagatgtattttttcatcgtattaggtgtaatatatatatatatgtatatatatatatatatataatatatatgtagtatacacacgtggacgaccattaacgaatgttgtatatgcttatgcggaacctttgtactctcttaaaataacagggacagatgaaggtggcaaagcgccgaattcagtgatcacttttttaatatattctggtggtgttaaatcgtataagatgttgacaatatttaacgaaggtaactcttgccaaccatccaaaatatttttgctgttgctgtcttcttcattactggcgtccttgctttctccttcagatcctttcttaccgcca

SEQ ID NO: 14529 - DNA, 400 bp, Saccharomyces cerevisiae
tgattattccgcaccaattttttttttatttatggtgtccgttttcccaacattctttctgcctcaatcatcttgttttatatttcagctaacaatagtaaagagaaaactcttttttgttaattttatctgagttgctcatgaaatgattaatcattgttgtttttacagcaacatggaaagcagcaaagaaaatgcaggaaaacgtgaagtgctttttttgatgattacgcaaagttcttttcaagttcgccataagaggaggttttccttttcaaaaggagcatgataccaataatttatattgccttacgcctcttattttttatatcctctttttagattttattaatttttttttttatttatatacatataatgtgccctgctttttacaacc

SEQ ID NO: 14530 - DNA, 489 bp, Saccharomyces cerevisiae
tcgggctagaatatttgtattgttttatgtaattataatcttaagcttgcaataccaatcactattaccatgttaatgatcccccagataaaaagacaagacagagcatatatcagactacattaacatctgtacacccccaactgctttgaaaaaacccatgcagttattattttcaacagaccaagtttttttatcgcttatccggctcacagaacgagccgtacaaccgtcatcagacttgcatggaaatgttgaaaaagaggtaaaaaagaaaatatcaaacccaaacacgctcgggctgaaaaattaatatggcaggaaacgaactgtagccataatgtacctgttcccgctaatagtaataccatcgtattgctaaggttagtagctaaaaatctcttactttctttattttgactcttaggtcttacaagcaatacaaaaccaacacacctatatataactaataatgtccggtaacggtgc

SEQ ID NO: 14531 - DNA, 478 bp, Saccharomyces cerevisiae
gtatcatctattatttgtatgtgcgttcatttatagactaattagaatatcatacgtacatataagactatacaatttatctaattttttcatttttacttaaaaattgatggtccatcgtaaacagcgttaataatttcttcgcccgatgcatagacaatgagaagccaaaatgcagaaacttgatactttcaaagaaagaggttcaactatgaaaagaaagaagatttaagtgccgatagagtatactagcatggcacttgtcaaatacagcacagttttttttccactccgatcattgcgactgtttgtgtccatcaagaaagcatattaccacagcgagccgcatagcatcgatctatttcatgataaggattggattgtgaaaagacctaaattcctaaatttacccaaaaatgaacattcaaaattagatatattccagtttaattttaacaagtccgaaagcaataatgtg

SEQ ID NO: 14532 - DNA, 440 bp, Saccharomyces cerevisiae
atatatgtagtccataaggggtaatgcatattactgttatcggcactattttatagagagttacatttacatatatcattctattacatttccttatctatgacgattcatgggtttgtatttttttggtaggatttgccaattctactaatactagaagaaaagattatacaaagataaagaccctgaggttaagtatttaatatttttctcaaactgtgttttttttattagtatgcaaagtaggatcattgggtaattggacagtttttcaaatactcagccttattctttaaaatcctgacggatttgaaaaaaatttcttctggtgtcatggcaccagcgctttctacgttgaaaataaagtggttcctcactcttcctaatttaactttatcagcaaactcttcgtatcttaaaacctccctggaaaccgtatc

SEQ ID NO: 14533 - DNA, 487 bp, Saccharomyces cerevisiae
gctatataaaagttcctaattgtgcattttttcaataacaatacttattcatccttataattatattctagcttcgttgtcatgggaacatagcccatacaccgcagttatttatgatcatttcgaacgggaagtatggatgaatctttttttttttttttttatagcacgcaactgaaaaaaaaaaaaagaaaaatttttcatcttcgctcgacgtttcttttgtagtactcatctctttttatataaagattaattagttattgtcgctttgcttttccttctttaaaaaatgtttcttgcttttggattttcagatgtcccaagatcattacagtattttaattgaacaaaatggctgaaggtgttttccaaggtgctatcggtatcgatttaggtacaacctactcttgtgttgctacttacgaatcctccgttgaaattattgccaacgaacaaggtaacagagtcaccccatctttcgttg

SEQ ID NO: 14534 - DNA, 463 bp, Saccharomyces cerevisiae
atggaccaatagtcatgcaagagaagtataaaacagtatatagtaaatagtaaatagaatcagagacagcagactcaaagttttatgcttaacgcgatcatcgactagtttaatactttattctatggcacttacaaaaaggtattaccctgctaaacaataaagatccctgaaaaaatggagcaggctcagagaatgtgacttcatgcgctttagtggtaaaaatactgcctaaatagtccctaaaaaaaaaagaataaaaaataactccgaagcggggagtcgaaccccggtctccacggtgagaacgtgatgtgatagccgttacactacatcggatttgattagcttgatttgaatagaaaaacatgttaccatatcagtaaatatgaatgatctttatttatatatatatgtccggaaaattgtaggaataaaaacctgttggagtaaaaatcaacca

SEQ ID NO: 14535 - DNA, 445 bp, Saccharomyces cerevisiae
tcaacttgagttctgttcgtaaattatgtaccaccctgttactcgtttcatattcacgctagagaagtacctcagcttactagatccattcacacattgcaagtatactaaaactatataaaatttaagtacgtaaactctttacttattattatcttcaatgtcatcacgtacttaattatgttaaatatagattgtgtataaataagaaataggatctgttttgaaaaattggccaaaaaggcagatttattaagcctatagagataaggttcttgccatttttcatacatttactgttttctcttgaatgactataatattgccaaaattgcctcgaatatgttgtttcatctcctctcatatttggctttctaagtcttttagttgtattggtgattgctccaattctgaatgattactatgctgctgactaggcgtaacc

SEQ ID NO: 14536 - DNA, 425 bp, Saccharomyces cerevisiae
aagcaaaaatgaagccgcatggatgagactctcttaacttgtttatgtaggtatatgttctctatattttatgataattctgcaaaatttgctggcatcggatttattttgatagaatagaatttttcaatttctctaagttttgctaaatcagctttggtaatgaagtttatagccacaccctttctaccaaatcgaccacttctaccgatacgatggatgtaattttctattatttctggtaggtcatagttaatgactaaagaaacttgttggacatcaataccgcgcgcccaaacatccgtcgatatcagtacacgagaatgacctgttctaaaatcattcattactttatctctttcttcttgtttcatatcaccatgcatggagactacagcaaagtttgattggattagccgctgaga

SEQ ID NO: 14537 - DNA, 460 bp, Saccharomyces cerevisiae
aatatagagaacatatacctacataaacaagttaagagagtctcatccatgcggcttcatttttgctttcatacggaattggagagcatttgtaattgttcattttgtgtgacgtagagtttaattaagtcattcaaactcaaatcgcgaagaaaaggagacagatcgcaaaattgtgaaattacatcgagctcaatgtccgagtccactctgaatctatcactgtcaacgctaagttcttcctcttcatcattagatttatcatcaccatgtgatgataatgttctcatttggttttcctccaagctgagactatttgtcctatgtgacaaaagctcatattggtcgctgattagtgtgatatcctcaagagatcccgattcatccaattggacaattatgacattttcaagttcatctccgaccttatctattcctgctgtcaaagcagcatcacttg

SEQ ID NO: 14538 - DNA, 417 bp, Saccharomyces cerevisiae
gaaataaacaaatagaaattatgataacatatataagtacacaagcgtttctatttcactttagaatattcttgttttttattcgttcttgaaattttgacaacattgccaaagtttcccgctctcttttatccattggttcttccttgatgttttcttgactttccgtttctttagtggttgcctcatcaacattatcatgcaactccgtcttttccctaattagtgcctcttgtggctgatctaaggatgcgtctagtttaattccttcactgcgactatcatctttgatccatgctgggagaatcattctctttcttggcttaagcttttgaacatcaccatcatcatcctcttgctcatcttcataaaccatctttacttttgctgatttcacaagtttctttgccggctctt

SEQ ID NO: 14539 - DNA, 408 bp, Saccharomyces cerevisiae
cccaagtttccatttcatcgttcgtgacacttataaactagtgtaagattatttacctatatataatttgataataatagcaaagaataagaaaaaaaaacaatcatgataagtaaaatagcaagtgttccggtacggaacaaccaattgcttttcacatcaaatgtcctcaaatccaatttcttcctgtaaagatttcgttagtatattcaaaagaaaaggtctcgaaaaatgttcaaaatacataccaaaaattcattcatatttttcgggcacactgagtcctttattgtagcaattaggtttttgcaaatctttgatctcttcgtgatttctttttgtagcagcgtatcttcagacattatccgcttgacaatctcatcatttgctggatcccaatcatcctgt

SEQ ID NO: 14540 - DNA, 413 bp, Saccharomyces cerevisiae
ctgtttgagctacttatgaagcacttttaacatgtaattgaaaagtactcgtaattgtgattcaatatatataataaaatatttcgtactctgaaaaatagctaaattacttgttttatgtaatttctatttggcggatccgctctgccaatggaaagagtggcatcttcattgcgcgatgattaattgacaatgaaattaaagcaaacagcgattctcaagctctgaaataagtagagtagaagaaaggatagaaactttttttttcattatgatatcaataaaaggaaccggaagatttctcctcgataactatagaatttggcagaggcgtgcattcaacagaccaatacagttaagaaaaggctataaagttttagccattgagacttcttgcgatgatacatgcgttt

SEQ ID NO: 14541 - DNA, 433 bp, Saccharomyces cerevisiae
tagcactgataagtaactatatacccactatcatatacatagatgtccattcagcattaattctcatcgtggtagatctcaaaggtaaagtagccgtttaggccttttgttatcgcccgtacttgcgaaaaacgggccaacaacgaaaaaatttgaaaaagtttccaccttagagaaggttctcaagcacaagggcacagcataagggacaccagcaagggaactccgactgacgttatccctgcaaactaccgctaatgaacgacccttctttactaggctaccctaatgtgggcccgcagcagcaacagcaacagcagcaacagcagcatgccgggctactaggaaagggtacaccaaacgctctacagcagcagctacacatgaaccagctcaccgggatacctccaccgggactcatgaacaacagcga

SEQ ID NO: 14542 - DNA, 500 bp, Saccharomyces cerevisiae
aattggtatcgatttcttcctccatcctttaacctcaaaatttctttttctaaagcgttaattttaatttattatgatgcagcttactcccaagagtgcatgtaatgtttgaaatatattcattgttcttgaaactgaatattattataaaacgataaaattgggaatggaaatatatggtatagcgtaatattttttttttagttattctaagtaacttttacatttcaaaagatttactaaaagttttgtttgagcatttgtttgttttgttataatccttagctattttcggtgtcttaatgagaaggaaattttacgactacagaaatgatgcagtggcgatatcatatgcaaaagaaatgtaggaagtactcagctctattaaaatggggtgtgttagtgtaaatgatacagatcttgaattgtatattgttttgattacgttaaaactcgttaccatagctaacctagaaataagtgctttggaacaccatgtt

SEQ ID NO: 14543 - DNA, 401 bp, Saccharomyces cerevisiae
aggctcaagccgttttggtggagtttttcattctagtttcggttctttcccactttttaaacgaccgcagttgtttgtatatgaaggtgcaaaatttgttgcatacgtaaacatgtgtagattattctaaataaatctgtgttattaaatccgaagagtcggcggttcactgtattacacatacagtggctgtcaacgttgtaaagtgctagtagagaatgagcggcgagatttacagactgaacattcttgtacaagttacaatgatgatagaggaaaaataagctatgataaatagttcatagtaatgcaggtggggatgatgcaagcgggcctatttattttgaaatagtactgaatggtttggaaaaggtggaattttcaatctgcaacgatatcgc

SEQ ID NO: 14544 - DNA, 446 bp, Saccharomyces cerevisiae
ttcaatgatcgccttcttttcttattttctttgttctgtactttagtacgcgaaaaaaaaaaatctgtatatgtccttatatatatatatatttatatatatatatgtgtatgtatgtgtaccgtaagcattactccttctaataatgaaaattcttaggaaaagagaaaggaagtagcgaatggaatgggatggaagttttaaagaacattagaatttatcctttgtcaaacttcatcacatcaaccaagaactatataaacctaccaaatgaattaagaaacctaattagtgaagagcaggagagtaaactagggttcttgcacatcattgaaagtgattttaaaccttcggtagcgctgcaaaagttggtgaattgtactacgggggacgaaaagatcctaatcatagatatagtatcaatatggtcccaacaaaagcaaaga

SEQ ID NO: 14545 - DNA, 467 bp, Saccharomyces cerevisiae
ttcttcgcatatatagccacatctcaaaaacttacatacagtgtatatatttgtggtacagtttctgtatagccaaatataccctgatataatcttatgtgatattatatacttccatcctaatactaaactttttcgtttaacgtgacgcatggtgcgaagaaaaaaaatagcaaatcgccactcaataaagtgagtagagagcattatatcaaaaaagcatcgataatatcgagtgatcatacgttgaaaatcatcaagtacaatagtgatataagccacaatgcaagctccagtggtatttatgaatgcttctcaagagagaactaccggtcgtcaggcccaaatctccaatatcactgctgcaaaggcagttgccgatgtcattcgaacttgcttaggtccaaaagctatgttaaagatgttattggatcctatgggcggtcttgtgttgactaacgatggcc

SEQ ID NO: 14546 - DNA, 453 bp, Saccharomyces cerevisiae
gcagcatatattttctttccccgccccctgggtgtcttaaattattgtttcaccacacaaacatatatatgttcttttttttttttgtaggacgtacggattcaaaaacaatttatacctatacaatgtagaaatgctaacgttgagacatagaagtaattatttaattaaccattttaggtgattattttcaggggtgtccgagtccacctctacaacatccacctgcccggtttgatacctgtaatcgcctgtcttggagtcctccacaaagcttatgcttctctcagatttcctgcgtggcctatccattatggctgctcctgcatacgacgtgccagtgccgccaatcatatctatatcatgattgctttccccgtcgcttgtactatcttcattcgagtggacgtcatgagcccatacagatttataccgatttgctctcggaaattc

SEQ ID NO: 14547 - DNA, 462 bp, Saccharomyces cerevisiae
gccaattagtgcacacacatacatatattttatatacttacatatttggttgcgtggtatatagaatctctcctttcgcttcatgaatgaactcattcatgcgaagtcaaaggaaaaaaaaaataaaaaaataaaagagcgaacgggaagacgagagaaacatcaagcgaccaaagtaaaagtcaagaacgactccacaagtgcgagggtcgcgacgtctctaactttaaaaacaggcgtcaaccatcaagtccgtttcttgatgccgccggcattcttcaaatccctccaaaaaaaacgcctctatgacataggcggttaataaaactggccttgaaacaacagatgcagtcatggctcttctcttttcccagcaaacgccttccattgcctcctttttttctcttccagaactctctcagcagtattctcacaaacacatctcctcccctttagcaaacc

SEQ ID NO: 14548 - DNA, 479 bp, Saccharomyces cerevisiae
gaaattgtgcggtgatcgcaaacttgaaataacatgtaatctctatgtataatttatataatgattaacaagatagaggtcgacacgtcagaatcaatagtccaattccacagccggagttaaatgcctcttttttgacgcggtcaacgttaagtttgcagtagcgctttcggcagtcggtgcagagctttcaggcttaaaatcctcgaaaatttgtcttcttatgttatcttcatcgcctagtgccttgtattcaagagattcgccaagctctttggaagctaaatcccacgtactaggcttgggcttaccggtttttgtatatgtcctttgcaaaagtaaccaaaaatagtgcttcttttgctccaatatcctacgctcattttggagtttctgttgtatcttttcgtttctttgctttatcaaaccatcaacaatcaaactgatgtcttctttatccaccttgtcaaatttccggt

SEQ ID NO: 14549 - DNA, 481 bp, Saccharomyces cerevisiae
tagaaatagatacaagagaataacatttttaaatgatgatcagttttgttttttattttattttttccagttagtttgttttgtctttcatattatttctttttttatcgatattttagcagaggccttgtcccttttttatgctaataaaattaaaattgttttatatacataatcataatttatcatttgttgcctcaaactgatattctatcttaaaaaaaagggaaaatgagtgagacaatatttagataaaccatcatcaaatatttaatttccaagagaaataaagtatgtataatataatgttaatgatatcaactaatgaatcgaagagaaagcgcgggtgttgacattgtgtatttcttgccatcaagaacaaacattatctagtatctttgatcacttaatatccttaatgcttccgtctatggtactgaaacttttcattttgggcaattggagggtcctattcccatgt

SEQ ID NO: 14550 - DNA, 452 bp, Saccharomyces cerevisiae
gatgaaagataagagataaacgcatactaaattactgtgtctgttattgtttttggctatatatatatatatatatatatatatatagtaaatataagaaaaacaaagaaaaaagaaatgagagtgaatttgagagcggcagaaagaaataaaattcaaacattttgatgtagataactggaaataactgaaggggataaaatattgaacgaaaagaaaatgataatcctccaagatcacataataaatataaagaaactcctcaggaatacagaatgtcctctgctaacttagacgcaaggctatttgtaaaattttatgatagctggttttcttgaagtgtagattgtggtaattgcggagtggaacccattgaggaatgtggtacagtgttgatttcatgttccaaattcggtatggctacgtctgacctagcattagcaatggcgttg

SEQ ID NO: 14551 - DNA, 411 bp, Saccharomyces cerevisiae
ggaatataggcacgtacgatagtaaataatcgtttacaatcataggaaggaaggaaaaaacaagtgtaacataaatacattctgtaaatctacaaaaatcgttagtgctgttttctttttgagattgaaaagtacgaatcatacacatctcttattctgagaagggtgcatatgacgtaaatcaatgcgtacaaagcggtttccggtgctggcctggcccaccacagttttggcgtggttgattttaaaaaccttcgggaaggtgaaaaaaccactccgaaggttcgaggatgacaaatcgccccttagctgtggccatacaagcttggcaccgacgaaaaagggaaaaaggaaaagaatgtcgtacaagaactcttacaaccacgttgagatttcatttaacaacgcccc

SEQ ID NO: 14552 - DNA, 494 bp, Saccharomyces cerevisiae
cgtcaatgtacttttttattatatattatgagaagggttaataaaaacaacaagtacaactacaactatcgagataaaaaggatacgagagtatcccctcaaatagagaaagaattagcgtatataatgctaaagaaaattcacgtttattatatattattatcctcattattactgttactattattattaaatgttttattgaagtcagtggcgtccttatctatcattcccaccaactaacgagtcccatgccatcagtttgacaactacctaatagggcatatgctggaggtttttcgttttgaggagtttcttcattcttaccctcaatctcattctctaattgagctctttcctccaattctcgttctttgggtgattttggcttcacatcaacaaaaacttctctttcgattctgaatctaattttttcatttacatcgaaatatagtttcgtctcttcatccatgggccaaatccatgcactttct

SEQ ID NO: 14553 - DNA, 477 bp, Saccharomyces cerevisiae
tattaatacgcattttttttatgttttctcgtttcttttcttttttttgttttatatcttacacatttttaatatactaaaagtaaaataaaaaaatacgtactgtttccctttgttttctcctcctctttgcttatatctccactgcgccatcgtcatcttcagagggcgtgctgattagagtcactgtgtctcctctgatgaacaccatttcacatcgtctttcggactcactcaactcctcgttgtttaattggtatatggtctctactgcatcactcagcacgatgttgcagtgtgagtcgaacgcttgcagtgtgcccaccagcgtcctggccccgcgcagcttgatgtacaccctctcatcgagattgagtttcaataaatccaaaggtgtctccattttcttgagtgtgcgtgatgttgtgtgtgtgtgtgtatttatctgcgtgtctctcccctgttgtattggttgct

SEQ ID NO: 14554 - DNA, 464 bp, Saccharomyces cerevisiae
aagagttttatcccaccttcattaaatactcattttatttttatttttcaattcataatatcatcactcttctctcttcctaagtaactacgtttttacatagatataatgatatgtgtaaagaaactataaaataacaaaaaaaaatcataatattactgcatctatccttcaccatgcaccaccgctatttatgctctccaattcatgctcgttaataggtttgtaccgaaacctagcaggtagctcgaaaatggaagcaagctcatctttttgcaatggcctgttaacgaatacagaggtctttgacgagctgagaccagcattagcgctatgctttattggcactacacggaatggtttataattttccatgaatttactcactggaatacactctttgctgccaggtaacattccgttggtagcgcaaggatgaacaacgacctcagttgcatgcttca

SEQ ID NO: 14555 - DNA, 418 bp, Saccharomyces cerevisiae
aattttagtgtcgttaatatctcttttatttcttattgttactatattattactgttttgaagttccagtttcatcaacttttgctaccttaattaaaagaaccactcagactttttaccatcctttagctttacctaatataatgaaatttgtctaagtaacataaaaaaaaggagtaaagaaaaaaaaaaaataagtaaatgaaataaaatataaaaaaattcttactacggtttaaaacaaagtgctcttccgctaacgtttcaagtttctaaagaatcgttagggccttttaacggatcgcttttttaaaacagtaaaacgttatttatagttatttataccaactatttctcgaaattcgtttttaaaataactgccatctttactgctcttctgctccttcctttgacatga

SEQ ID NO: 14556 - DNA, 466 bp, Saccharomyces cerevisiae
cttcataaagttgatcaaaggtgctatattcagtaacaaaatgcttataattaagagaatacatccctaataatgaatcatatctttcatattttagatgatattgaaattatttaactatacataaggagagtcctcaatgaaatggagtaaaacagacgacatgataataactatatcaattcatgctttttagtttctctttctgtaacgtctgtctctttgagcggaaacgttgatgacagataatggcaacttcaaacccaaagatttaaccaagtcagaggtttggttgtcaacgttcaaaacaccgttagaacgagacaagtccaaagcagagacttctgggacgtattgatcctttctttctctttcttcttcttgcaatttgaaagaaatacctctaactggacccttttggattcttttcatcaaatgagtagtgtaaccagcaatcttgtttctc

SEQ ID NO: 14557 - DNA, 467 bp, Saccharomyces cerevisiae
agcgaacaaatccatattcaaatattttttctcctttattcggttctggaatctattcatatatatgtagaaaatagtcgagtacatatgcaattatagggtaagctgatacacaaatgcatggtgtggtcctcttcctttgcttaaatgatatgtttcgttttgaagtagttcttcaaatagttgacttgccaaacacccagcgaggacaagacaataataaccaaaattgagaaatttcttacccttctgttggtagattcattggtgtctcttaatctctcctctctgtttttcaagtaagtcaattcgtcgacaatttcgtcggtaatttcctccactctacgcaactccacttctataggtttcaatttttcgttggcactgatcttgttccagtcacgagcttcagcaccactctcaatgtccaattcaatggccctgcttaaagaacggccacgatactg

SEQ ID NO: 14558 - DNA, 423 bp, Saccharomyces cerevisiae
ataccgtaaactatgtgaagaaatattatattttatcgtttaattctacaacgtttatatgtctgtatgtgtaaaaaaaaataaaacgaaaaaagcagtgggtagatgagaaaatttacagtaatttaaggttattattctattattgcacgaaatgaaaatggctcgtacgcatatccttcaccttcaaaaaatttggacattgcctccacccaatgcaaacgtagcgcatgcaacattgcggaagtaccttccatgaaaactaggatacaaacggttaaaacaaaccacatagcaaataagaaaaccaccttcatgacagccaaaggcgaccctgagtttttagaactgaaagcgtttgaaattgtcatatcccataaaacactagataattgcgcatgcgccaacgatagtgcccaaaga

SEQ ID NO: 14559 - DNA, 500 bp, Saccharomyces cerevisiae
agtgactattatgtgttgataaagattctattattatatgtaaattttatgtatggtacagataagtaaattcaaaacacccgtatttcctaaagggaataaatattatttgcatttatattctatcatgttaaactactcaggacgtattttcgcttttattttcgattgtgatgtgcatctttcataaaggaataaccctaatgtgttcagaaccaaaccgaacacttgcagccaagtaattcttcttccaataaagacccaactaaccgcaataatggcaaagcgcttcatcagattcgctattgaatatgttaaagttgagacctcacccagtaaatgaaatgtaatcattgcctgaatgaagtggaatgtcccgttcagtaaaaataaagagactggaaaagcttttattactgtagaagagctgttaatttgaaaaaaatacctaaatagtacaggaaattctagagtgataaaccagccaaacgataaacaaa

SEQ ID NO: 14560 - DNA, 416 bp, Saccharomyces cerevisiae
aattttgtggcatatatttaaggtcttgggaatgtgatgattattattggagaaaaaattgccatctaaaactctttatataacatgatgaggtatacaaataaaaaatactttatatcttataattatgcaaataaaagtgcttccatcaaccgctacttcactttttatctgaactatgaatggggagctcatgatgattacctgttgatattacgtgaggcggaagagaagcacgagacacgggtcactctcgatattaccggacagtttacttagactatgtaacgaatatgagaggaagaaaaacaataaataaatacaaacctctccgcagttttatgaaagaacaggacagggcgtctataccgatttttacatctatcttttgagtgcttgaaaggagacgctggact

SEQ ID NO: 14561 - DNA, 488 bp, Saccharomyces cerevisiae
ctgtttgcttaatctttcaaattttaaccttatgtttatattacctttttatttctactatatagcgtattacatgttttttccgataagtataacgaaatttcccagcagcgaagaaagtgaaaaaataacagtgaccataatgaacattcctctctttccattttgcacgtattcttgcagagaagaggcactctactcggaagacagcagatagatatatagactgtagcggttaacgatggccaaaacaacaaaaagagcctccagtttcaggaggttgatgatattcgccataatagccctcatctcattagcatttggagttagatacctatttcacaattctaatgctactgatttacaaaaaattctgcagaacttgcccaaagagatttcccaaagcattaatagtgccaacaatattcagagttcggattctgatctagttcaacattttgagagtttggctcaggagatcagacacc

SEQ ID NO: 14562 - DNA, 454 bp, Saccharomyces cerevisiae
ataagaatgggagctgttgctttataaaaaatgtttttcaagaattgaaaacggttacatttaaatattatataaattgaaatctttgataatgaatactagtccaaaaaaaaatacaatttcaaaaaaataaatgccatctcctagaatcgaaccagggtttcatcggccacaacgatgtgtactaaccactatactaagatggcatatgattttacaatgattcgatggtgaatgagttataagccatgtaaggatcactagtctttttccttaagtaactttttcgcttgtgatatcttgaaataccattaaacatagataagctattgaaatgtgaagaaaattcaaaaaaaaaagggaacagagtcatcttttgggtagaaactaagcttcaatggatgaatgtttacccaattcatgtctactaggtgttcacctcgtcatttcaacg

SEQ ID NO: 14563 - DNA, 431 bp, Saccharomyces cerevisiae
tacgcatgaaagactactatggaatatcttttcctgcctttgagctgtactgttatgatagatttattaatagcttaaacgcttttacaaaatatatgcaatatacataacgggttaaataatgggttgggaaattggtaatcacggtataatgagtacctgttttcttctatttaaaaaaataaaaactaccaactctttttggtaaaattagtaacctaccaaagtcaatcgatcaatgcatctaaaaaaattcaccttcaccaaagtagaccaattgacgtcatttactgaaacgaatgtgcagggtttacaagtcatctgaaatgctgtccaaattgataggttgaccaggcttgaaagcaggaagacccaagtagggacaaccactacatctaaaggcatcccctagagaacaagaaccacagccg

SEQ ID NO: 14564 - DNA, 458 bp, Saccharomyces cerevisiae
aaattcagtctgcaatatatggactaatatataggctaatatataggctaatatataggctaatatataggccatattttgatgatttcgatagattatgcataaagaattgataggaaggaacttgcctgaacaataatcttttactctatattttctacttattatacatgattcagaagctttgttgaaagggggaaagaccgagcgatataaaattgatgaaaaattgatattacagcatcaattgacatcaatcattaaatcatcattagcttcctgtggatcaacaaactccctgctggctcctgccaatagttctcttctaatctcaggaccgatatctttatggcctctttgacgaacagtttccaacaagaaatctctctgatcctgggtaatatcgttcttgtaacgttgtgcaaatgttaagaaagccttgtgccatatcactggga

SEQ ID NO: 14565 - DNA, 495 bp, Saccharomyces cerevisiae
ggcgtcttttagataagtgcaaatttggctacttatatacaactcagatacggaatatacctttgtgtaatacacttttttattggtaggtgctatatgatgtgactttgcttttgcctcacgcccctttaagaaggtattttgtggcatcactttgtatgctgatcttttaacgcttaaccagatttgaaactatctctattatgtcctctgattttaattaggatggtatataactggtcctagaaccgaagattctgcatattcgccgaaaaccatcccttaatattatagacataaattgccagtctgagaagaatccaagaatctatttcataatgtacattcctaaacattttgagtccatggaactctcaaggtacaaattatcaaaaaaacccccgctaggaacactattctcctctaaggctagcaggcaaggtttcttcggatggagaacttcttccaataaagatgaccccgattttggtatgt

SEQ ID NO: 14566 - DNA, 488 bp, Saccharomyces cerevisiae
atgctatgtaatagacaataaaaccatgtttatataaaaaaaattcaaaatagaaaacgattctgtacaaggagtattttttttttgttctagtgtgtttatattatccttggctaagaggcactgcgtatacttcaaggtacccctgtgttttgaaaaaaaacaacagtaaaataggaactccgcgaggttcaggaacctgaaacaaaatcaataaaaacattatatgcgtttcgaacaaaattaaagaaaaagaataaatatagattaaaaaaaaaaagaagaaattaaaagaatttctactaaatcccaattgttatatatttgttaaatgccaaaaaagtttataaaaaatttagaatgtataaataataataaactaagtttacaacaacaaagcagcggcaccagccaacaaagcaccagcagctggcaaagccttagcagcagcaccagtgtaagaggtgacagagtgagttggagcagca

SEQ ID NO: 14567 - DNA, 487 bp, Saccharomyces cerevisiae
ccaaaaggcattgtcatttattaaaaggtataaatatgtaaatgtatacttaatgaccgttaagaaaaactactagcctcatcactcccgcagatctctataattgttgtttgaatacttgatacggtggagtggcaaggacagtctgcgcagtcctaatatcgatattgatgtcttcgatcagagcttccttagtagtgtagttcaattcgggtctgatatgacctaaaatattgaacttgaccctggccccataaaaatcatttttaaaatcatgtataatatgtaattccatggttttgaaatcatttccgtagaatggatttttcccaactgaaagtaccataggaagtacggacaaatcatcgttcgcttcacttaaatattgaccgtaattataaaccacagttcttccatcccgccttgtttccaccgatagttcttgaccatcaacagttttaatgtgagcaaacccaaagtaaacccc

SEQ ID NO: 14568 - DNA, 443 bp, Saccharomyces cerevisiae
tagaaagaaaaggtaatcgtacattttttaatagtgaaagatagaggatacacaaaaatcatgcaaagttttatatatttgttatgtatactcatattccttcaatatctaagtcatactaacttctagggactttaccaaaatattatttataaatttattgtttcatttcttccgcatccttcatctcctccgttaaacccattttcttatttaatctatcatatttcagtctatctttatcgctcacagagggtttaatctttcttaatgcacttcggaagtcagacatggtcacaataatttcttcgccagatacgccaaccgatagatcctcaaattccttgtctaagtcattatcaagaacagattgtatttcttcgctctgaaaaaacttcctttttagagccaagactgaactctccctgactaaagcagccaag

SEQ ID NO: 14569 - DNA, 454 bp, Saccharomyces cerevisiae
acattttcgcttttgtagttgagtttaaaaagtatttatagcattttttttttttatagatatctgtcttccatatggcatccttttctttagtcactaattgagtcatctggaaaaaaaaacaaaggagacagggaaaattatctcattattacattcacgaaagctgccccaacagaaaagtagaataaacacctcctctctcaatgacgctgcaaagaattagtaaagattatctaaagcctaattatggacttatcttacttatagtgtcttattttttcaattcttctatggtagtttctaccaaagtcctagaaaatgacccactggaaacttcgcaatcaagaattaatcctctgcaaatcctgctagtaaggatgtctatcacgtactgttgtacgctagtatacatgcattggaataaacaaagtgttccagatattccatgggg

SEQ ID NO: 14570 - DNA, 499 bp, Saccharomyces cerevisiae
gccaaaacttagcgcggttttttctaccttcccttttttcatctttttgttatatatatatacagagacactcatgcgaattttcgcaaaacgaagaaaaaaacataaaattttcgtttgtatctacatgactatcctttaattattacctttctgtcaaatgttttatgggaatatatatgttaatatgagccaataactcactaaaaactcactgatttcgttccctctgtttagcttcctgctcgattctcttgatggtctgctctctcttaaagtcgatgaccctcttctccttgaagtacttgatccagctatgggcgcaattctcctcaaatttttcattttccaccttgcagtgcgactttatactcttgctattcttggggtccattgcgtccaagatgtctgccttgtccaaacactggaagaatgcgtccctggactcccagcacaactttctctgtgaacgggtattagggggttgtgattccttttt

SEQ ID NO: 14571 - DNA, 429 bp, Saccharomyces cerevisiae
gagcatcaaatgtgcgctggattctgcctcaatgcacttagtaaattgcagcagggtttagaggggaacgcttattgagaagcggtattcctgggctggtaccacaccgaagtgagcttaatttgtttcctgctctgcgcgcgctgaaaaaagttaactatttgagacataaaaacgctattctggatgtatgggggtattttatgtttgggttaaaagtctcaaaaaaaagatgaggaaggattgtggcacatattgcatacaaatttttaatggagatttatagctaaaagatagcgtattcatacattgaataacgcagttcttgagttaggaagaactgccttcttcctatacgtctaagaattaattatgtaaatagtatatagtttatgttctctgtagaaccatgggataaattcaccgacg

SEQ ID NO: 14572 - DNA, 443 bp, Saccharomyces cerevisiae
atcttcaattaaggaacagtatataagtacagaattataggtatagattaaatgcgaacgtcaatattattttcatcagtcgtattcttggagacagtcaccaggcacaatgcctctatcttcattgaggtatcttttatcgtcaacactgacgtgaatagaacccttttgtgtattacacttttctaccagacaccatccatcggtatgagtggccagaattttaactttttcacccagcgagattcttatttcgtctgtcaatctaggctcgtaatcctgaataactgtatatgtcttccctaattggacgctagcctccccattatatttggagtttggagtaagcggcaatggtttagaacgtgacaaatgttgtaaatgctgatacattttactttgtcttctttttttccttttctttagtggttttgatggggtgg

SEQ ID NO: 14573 - DNA, 401 bp, Saccharomyces cerevisiae
ttgtagattgaaggtagataaaaattaatgtaatatatatatatatatatgctatgtatatgtaacaacgaaaatgttaagaattttagaacattgaataataactatttccaaatataagaggtagtctccggcatacgacatagcatgttgtggtatattataatctataatggctatacaactagacgaggtgatatattgtcctgtattattcttcttatatttgtgacaagttcttgacacttttgctcacccagctccagtaaactgaacaattgatcttcattaaaatcaccattgctgtctaacaataaaacgtttttcacgactttaccgccattgacgaactccagagctaaagtgtggacagagagcgaaatcttcaattgctcggcagt

SEQ ID NO: 14574 - DNA, 464 bp, Saccharomyces cerevisiae
atgaattaaaaggaaaagtattatgcatatatatatatatatatatatatatatatttatatatttatacacatagaattattttacagtaaaggatgctacaccaccccgggctaactttatggcttctactatttcaggttccctttcgcgtcttttatctaatctttcctttttgtcttgaataaactctaactcagttgaaagattgttccatggtcttgtgtcgcctgtacccgacatgatcaaaatcatagtacctggtgtagcattctcgtataattgtgttagatgttgccctatatcatgaagaaccatggacgcatcgaacgaaggagtttccttccgtggctttttattatagttgcgtgacctctctaagttcttgattctccccacaataagtttgacatctttatttagattctcgtgaatatgggtccatgtctcatcatcttcgacgc

SEQ ID NO: 14575 - DNA, 430 bp, Saccharomyces cerevisiae
tgaataccgtaagaaatggaatagaatatatacgaatgtatacgaatattatagagaacgttctcttttatttctataatgaataggttcgggtaacggttccctttttaggtatttctagaagatgagagaagagggaataatgagaaaggcgaaaaataaaggacacctttaacgaaagatcaaaggtgtccttatttacttacaatagctgcaattagtacgactcaaaaaaagtgaaaacaaaactgaaaggatagatcaatgtcttacagaggacctattggaaattttggcggtatgccaatgtcatcatcgcaaggaccatactctggcggtgcacaattcagatcaaaccagaaccaatccacttctggcatcttaaagcaatggaagcattcttttgaaaagtttgcctccagaattgagg

SEQ ID NO: 14576 - DNA, 490 bp, Saccharomyces cerevisiae
attgcatcaggtccataaaatgtttttgtctgcttttttttcttcatgtattagttggtttttatttttatattttcatttatcttattcatactttttactccttttttcttcattctttacgatcttggacattcaactagcctatggtaacttttcttattactttgcccctccttgaggtgagtaaattctgcatctatttttttactatgcaaaggatagataaacaattcacatgaatgtcaaaattttgaaaaacactcattattcaaaaagattgcataaaaagatatacacttaaagtgcaagattataccaactttcagaatacggagaggtttttaagtggatgagcattttttcataacgttctaaaacgatatttacagtatttggtggctaaatgaaaaaaagccgtatcatgactgtgctagagaaagtgtggcagttacataaatcaaaagatacaatttaggtgcggcctcta

SEQ ID NO: 14577 - DNA, 483 bp, Saccharomyces cerevisiae
aaactttgtttttgcttcttatggattggatgttataacagtagaagtaattttaggataattttaaataaaaataatattaaaaataataataatactaataataaatgagaataaaatgttgataaatgagggataaggtctattcatacgtctcatccaagaaggagaaaatatcagaatcttgagttttaaatagattaattattgaaattccaatcgaatatggaatttcttgagtatctctggaatgtgttatcggtttcatttcattggatggtatcaaaaacctttttaacgatctgttatttatatcacgcacgatcacccatcttactttaaaggctttgccatatttttgttcatcttcccatatactggtgtccaaatccattttcaaatccgataccatttctgcaacgccacagaatcttcctgatgtgttgattgaaaaaaataaaaacactttggctcccgaattaa

SEQ ID NO: 14578 - DNA, 435 bp, Saccharomyces cerevisiae
tcttagttggtagcactttgatgaggtctctagcaaaaagtctacaaacaaattcttgaaagtgtttgattgtatatcgatatatcagaaacatacatatgatttttatcttgtgaatattcatcaaactccgtttttagcccccgtgtaagttactttaatgagtatttgatccttttttttattgtgttggtttttatatgttttgttatgtattgtttattttccctttaattttaggatatgaaaacaagaatttatcaaagaaaaaaatcttagctttaagaactacaaagtaaataaaaaataataaatcacaccggacagtacatgaaactggacatatttgaggaatttcttttgaagagttgagcattcaaactggccggtcttgctgtggcctcaatccacttgagctccaaagaaggctctgaa

SEQ ID NO: 14579 - DNA, 493 bp, Saccharomyces cerevisiae
gcatggaggaaagtaattgatattttttttaatttcggatcgttcaaattagtaaatatataaaaaatatatatatattcatgtgtatgactaaaaattctctcaagaaggcttggctttaagctctaattccgtctgcattcgtaatagaaatatctctcaagtcatgaatttagagataaatgctttagtttgtcgtacttcatctttctgaatatctaaggtgtatgcaggaatggcataattttcccaatcaatatcccttccttcctctctattagattgagacagttctatccaattgacgctattaaacggtttattgcttaggagattcttatttttttgacaaattaccaaattattgataaattcaggatcccagaacatacggtgattctcgtccttccacgaagcatgcgatgtatccggttctatttccagaatttctaaccaacgtcttcttggcaggcacttgtccaacgccaagaac

SEQ ID NO: 14580 - DNA, 465 bp, Saccharomyces cerevisiae
ttgcatcggatttttgaattttccttatgtatatacataaatatgtttgaaagattaattagaaaaacatgtgcttgttgatccagtttcagttattaaaaaaaagctgaaatgggaagagaaaaaattgacaaaataatatattacgaacatttatgatgtcgaaataattctaattcttttttttttttttggattgaacatatcgaacgaacatgtttcgtttactcgaattgaggaccagcggctaatacatctggtgtggctctgtcttgataaatcttgaaattttgaacaaacaagttggccaagttggtaactgcacctctgtatttggattcaccttgagaccagtttttagcaggattcaaaagctcagctggaacaccgttaaccttggtaggtacttgaagattgaaaatcggtaaagtttcgtacgtttcattggctaacgaaccatcatga

SEQ ID NO: 14581 - DNA, 405 bp, Saccharomyces cerevisiae
gttaaggaatagatgcacagaatatgctctgcacttgttttctaatgttactcttctcatataaaaattgtagatattaagaaagaaagtatgtaaactaatcaatctatacctaaaagaatattgttcaatattctataaagcacgcacggcatggtaaaatttttaacgattgtaagattacaacaagttgcaatccattcaagctaaaaaatcaaagcaaggaaaagctcagaggctgtcgtgaatatgtcaaataccgtaagagccatttcaccagatataacactattcaacaagacattgacattccaagaaatctcacaaaacactagagaggctgtcatatacattcatggaggtgcatggaacgatcctgagaatacgcccaatgattttaatcaa

SEQ ID NO: 14582 - DNA, 431 bp, Saccharomyces cerevisiae
taaaccgagtatcactctcacttttataaaaaagcgtaacatctaatcattaatagtaataaataattaattttttttttgtaagtttcagtcatatttgtactcaggaaagatatgaaaacgataatgttgataataagaataatagtaacaataataaaaaagtaaaaaaataaagcttaatttgagtttcctaaacgtaccgtatgttgtgcatctaatattaatttaatgtgtataaaggcgtacaaggagctttaaaaaaaaactgtttgtgtaaattacattgggcatcatttaaattatagaatacacaatttcatattcagcaaacataatgcgataattaattgtcttccaacacataccataactgtggcatagaaaagtgattccatactgcggcaacttcttatacttcccgggcaaca

SEQ ID NO: 14583 - DNA, 435 bp, Saccharomyces cerevisiae
agtaacgaatgacttgctgtaactaattggtttatatttaaatatttcactttttaaagggcgtttgcatgcgaccatcgtcgatgattcatattgttcggatgcggaagatggcttccatgagttttgcacgccgtctcatgtgattgttggagtcatagctcgcatatcttcctattgtcagatgtaatatcgacggaaatggcatcttggagtatggaagcactattctgctttgctccaatatttaggatgccgcatttttcatatttttttttacatttttcgcttacgtatataaattgctagcaagtattcgctctctctgtcttggttatctaattgctaaccgtcgcaattgaaaagaaaaaaaaaatacagaatagacgatagcggattgaacgatagcatactattgagtgcgttttcccttct

SEQ ID NO: 14584 - DNA, 466 bp, Saccharomyces cerevisiae
cgtatatatatggttagctttacgcaaactacttcttttgacaattgaggcagttatcagctaataagaaaaagtagttagtatcaaaagacacaatttatttatattaaccaaatttttcagaacatcctccggaccgtcagtctttaacgccgagccgccgatgatgggttggagtcaaaacgagggaactcaatattaattgcggagttgagcgatgatgggttggaactatataaagcatcggaaacgcatggctaagggaagtggaagaatgcaggttacaaaaaacggataagaacaaacttgtttcgaaatatggccgctccagattatgcacttaccgatttaattgaatcggatcctcgtttcgaaagtttgaagacaagattagccggttacaccaaaggctctgatgaatatattgaagagctatactctcaattaccactgaccagctatccca

SEQ ID NO: 14585 - DNA, 469 bp, Saccharomyces cerevisiae
tgaaatgtcctttacccctagtatactgtgttaaatactattgtagaccatatacatactgtaattgaccgttaacggttattatgctgagtcttcttccgttacccgtcttttctatctatttcgaaaataaaaaataagtgaaaagaacgaaatttcacaaccattaacaatacagataatgaatcgaagttgttttcagtctcaattcaaaagactcatagccaaggccagttgattgatttagccacaagtatcattcaacgtaatatccacaggtgttttttttctcaccggaaggcgaataaaatacaggagctagagcgtgtaagataatgaacaaggaatctaaagatgatgatatgtccttggggaagttttccttctcccacttcctatattacttggtgctaatagtagtaatagtgtacggtttgtacaagcttttcactggacatggatccgacat

SEQ ID NO: 14586 - DNA, 436 bp, Saccharomyces cerevisiae
aaggaataatcggaattttatgtgtagatatatagacattatgtagcagcttactcggtttcatcttttttctctcttttcttattcaggcttttagcgattttgttatagaattggtttagcgacgagagggggaaactcaacgtttcgaagaggtattccggtagtttcgactgtagcgagtatagttcctcggtggatcgctgtttaagaacgggcgcatatatgacttctgtgacttgggcctggcccttgacaaatccgagtttatagtccattatcgaataatcatcggaagatccccctgagtgggtgccctgcgagatgtcgaaccacaacccagaatcatcctcgtagcttttatgtacacgtacgttacagaggtactcgtaaaggtcctttatgacttctgaattttctgcctgttgggaagtct

SEQ ID NO: 14587 - DNA, 446 bp, Saccharomyces cerevisiae
tatgtgttgtgtactacgaaaataagcaaaaaataaataaaataaaaacaaaaacaaaaacaaaaacaaaaacaaaaacaaaaacaaaaacacatattgttatgatgactggacgaaagaaagatcgtcgttactttcctaattgtttgtcttcagtacagttattatcagtgttctctttcttttttattgtactatgtgatgttactgatacatcacgcgcttcctttatgttttctttttttatgttcgttacaggatttatagtttttacagtatattgacttcaataatttctaatattcagttcctattaaatttgattattccgattagatcggtcggcgctaccaaaaagaggcgaagaaaagaggaaaacgcaagtggataaaggggtggggggcaaaagtatttaagaaaaagcgatgcgatggagagaacaaatg

SEQ ID NO: 14588 - DNA, 475 bp, Saccharomyces cerevisiae
agagttaagaatatagtaaaaagaaataatacatacgtgtatatttgaagaaagaaataatcattaaaagttgtcgtagattaattataataaagtccatggtttgaaaaagaaaaaaaaaaattaagaccaaaataaaagctcaatacccaaaagaaaaccgaacaccgtaataatacaaaatcccataaaacaccatgtgatggacttaaagacagaatttggaagcagttcaaagaagaggaggaaagaagaaaactagttcaggtatttcgaggagtactagtttcactacattgatagtagaattttagcacgtcatccacagatattctgttaccaggggaatttagcgactgatctacattgaaacaatttcctaattcgggcgtatgtagcgcactcaactctcttggcttgaatttgccagaaaatgatgaaacagagggagaggaaggattggtcttttcgctga

SEQ ID NO: 14589 - DNA, 478 bp, Saccharomyces cerevisiae
ccgcgtttatagtaaatatgcatgtatatatatatatatatatatatatatgttcatctctcttatagatgtcaatctaaatacttacaacacacattaatgaatacctcgtatacgtttaagggcaaatgtactctcgcagaaggaaatattgcaagtaacttggataactaaagccgagttaaagatctgccaattgaacataacatggtagttacatatactagtaatatggttcggcacacattaaaagtataaaaactatctgaattacgaattacatatattggtcataaaaatcaatcaatcatcgtgtgttttatatgtctcttatctaagtataagaatatccatagttaatattcacttacgctaccttttaacctgtaatcattgtcaacaggatatgttaacgacccacattgataaacgctagtatttctttttcctcttcttattggccggctgtctctatact

SEQ ID NO: 14590 - DNA, 480 bp, Saccharomyces cerevisiae
tctttttaattttggtttcttccttctgtcatattattttatcaattttcttaaatattatataatttaatccgaaacgttccttataaagtgatatttctatgcatacttttttttctttgacatgagaataaattcagccagctacttcctatcacagaaattttagttaaacgtaagcttgcagttatggattcttctgcgaaaatactatttaaaaaactatagcataaattaattgtaggaaatactacgagttctgtgcattcatttaactttcaaaagcaggtccatgtgatatagtaacgttctggccttttccctgacagataatgattcgtctgtaatattttttctaaccagatcgtataatcctacctccacgagttttctacatctttccaccgtggcacgtgttacttgtacatttgatgtactaccttttgcagccggggtgcgaacgaactcatcgccttcatc

SEQ ID NO: 14591 - DNA, 472 bp, Saccharomyces cerevisiae
tttgccagcttactatccttcttgaaaatatgcactctatatcttttagttcttaattgcaacacatagatttgctgtataacgaattttatgctattttttaaatttggagttcagtgataaaagtgtcacagcgaatttcctcacatgtagggaccgaattgtttacaagttctctgtaccaccatggagacatcaaaaattgaaaatctatggaaagatatggacggtagcaacaagaatatagcacgagccgcggagttcatttcgttacttttgatatcactcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcat

SEQ ID NO: 14592 - DNA, 422 bp, Saccharomyces cerevisiae
tacaatcaatacttgcttgaacgcttgattttactgatattctatccaaaagcaagtagaccagaaactctcaagatgttgcaaataccgttcgatgtttttggtttagattgttttaatgttgatgcttttttacttatttttggaagcgtctttttaatttagttttatattataggtatatgaatgtgtttatgccaataagggtttttttgtacagttatgtgattataaacagtcttttgtctagtttttttcaccagtatcggcctctatttataaaaaacggagcagctttcggtgtcagtaattctgaaaaaatttgtgtcactctgattgtaaatgaattaatttagctagatagttgcgagccccaacgagaagattgtcagacaaagacaacattcaacaacctacatccg

SEQ ID NO: 14593 - DNA, 414 bp, Saccharomyces cerevisiae
gacagcattcgcccagtattttttttattctacaaaccttctataatttcaaagtatttacataattctgtatcagtttaatcaccataatatcgttttctttgtttagtgcaattaatttttcctattgttacttcgggcctttttctgttttatgagctattttttccgtcatccttccccagattttcagcttcatctccagattgtgtctacgtaatgcacgccatcattttaagagaggacagagaagcaagcctcctgaaagatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgct

SEQ ID NO: 14594 - DNA, 418 bp, Saccharomyces cerevisiae
gcctgtaacaaacgttgattgataccaatattttttctctttcatttatctctctgtatatctaaatagctatactatacatcgaataatgctttcaagcagatgccttaacgtgctccaccacttcgtcacaaaattgacctaacttagaggagtccttacattccgcataaaccctcaccgcatcctccgtaccactggctctgacaaagcttcttcccatgggatacttggctaccacaagatctatcttgtcttgcaaccccactggattgagcaattttctttcctggtccgtggtttggaaaattgacctatcaggaacgatgcacttaaccagcttgttgggcaaatcagtatactcttcatcccaatccattggcgacattttcaaaatcgccaaagtagcaaggacagc

SEQ ID NO: 14595 - DNA, 449 bp, Saccharomyces cerevisiae
gctacttgttacaacaaccttttcggtagctttatatactataataaacacaagatagcctcataactttactcatttcttattatacatttttttagttttcctgttaaatactaatatatttgtactttaaaactgttcaaaagattagacagaaatgaatttatctgccgcatttctgcatgcacgaagtcgaatatgcaaatgtttatattggctttattaattaaacaaactatatttatgtgagaaggtaaagccgtatttccatgcgttaatagagtaaaaaaaaaagaaatcataatcttctacctcttctaccacccttctttctggtggagtctgatgggactggagtaacgtcttcgatacggccaatcctcaaaccagatctggccaaagctctcaaagcggcttgaccacctggtcctggggtcttggttctggta

SEQ ID NO: 14596 - DNA, 483 bp, Saccharomyces cerevisiae
tactcattctttagaaataggttttcgtactcaatatttaagaaggtaattaagcattaaaaggattttttttttttaaccttgattagtaacattgtgatatacatttgcctacgtacatttctgatgtcctaagatttctttctttttttcggtcccttaaagacaaccgaatctctctacgataatgtacgacatacaatgtccaaaatggtgctttcgtcatcgtcaacgccattagtacattgtccctcttttcgtgaaaaatgaaaaatcttggttatttgcagtgtacatggaatatggactttttttttttctctgtggcccgccggtgttctccgatgaatattaaaagaaatgtcacacaaacgcaatgactcttttttccctggccttgaaaaaaaaaaaaacggtaaaaaagtaggacaaatggtatggacaaaaagtataaatactttgacaaaatccccactcatcgat

SEQ ID NO: 14597 - DNA, 408 bp, Saccharomyces cerevisiae
atgtactctatctactgagaccatgtgtttttatgtttgtaatgtgtagcaaaaaattatcatctgctaacaattgcttacttttagaaatcacatttaaggggaagttttaaatcattcataaatatcaatgcatttacataaacatcattttctccggtttttgataactctgtacagaaataatggattatagttttaagctaagcggaaaagccaaattattcttcaaaattttcgatgaagtcggagtttatttcttttaatttccctaaagtcaagggctctttttcatttcctgcacattctttcaatatcgctacaagattgtgtattctcttcatttggtttatggtcttttgatcaacaacgccatttgaatcttcgttttcagtccttgcttttgca

SEQ ID NO: 14598 - DNA, 447 bp, Saccharomyces cerevisiae
aaatcttggcgcataagaattaagcaatatgtccacaatatttttattcagcagaatttacatatgacttcgtatttagtgatataactactcatcgggactgaaaattttttatttctgcctaaatacagatgagatgagctttatagaattttacgctgttaaaaagttaaacggtaacaaagcacagttagttgaacaacggtatatagagaatggctaaaggtttcaagttgaaggagttgctttcgcatcaaaaggaaattgaaaaagctgaaaagcttgaaaatgacctaaagaaaaagaaatcccaagaattgaagaaagaagaaccaactatcgttacagcttctaatttgaaaaagcttgagaagaaagaaaagaaggccgatgttaagaaggaagttgctgcagatactgaagaatatcaaagccaagccctttcta

SEQ ID NO: 14599 - DNA, 406 bp, Saccharomyces cerevisiae
tcataggtttctcttcaaaaggagaaagtttaaataggcaactgacactgaagaggtatagtcatgcctaccgcgatttctttgacacagaattgaaaaattttgcattttttggtaatttcctaataatacgaagtgcaataatctcactttgataggagcacgtcatgatggtaatttcatactactgaacgtaaatgttgaaggtgaatttgtaaagctttgttatttgaagctgtacacctaaagggcggtaaattgttgggtgttagtaccatgccattaattagaatttgttagcatttttattcatttgtgcattatgggttcaaattcatatgactgaacgtgtagtttcatatccagtcatcaagagatgctgaaccgcccttcaaaaacttgacga

SEQ ID NO: 14600 - DNA, 440 bp, Saccharomyces cerevisiae
caataatttcgagcacacacatatatatatatatatatatatgtatgtatgtataagtatatatgatggcatactataccacacgtacgactataattacaaacaactatcaagcaactacaaggatctctgtgggctagtggcctgcgggctcaattttgctcttgttcctgaacggtgaattctgtagtctgtcatccaggggaagggcagggcactcatcaacaatgtgatagtcagaaagcaataatgttttgtattctgatgagctttcactatctcttccgcaatacccctttttgcctatattacggcatcatctttccccgcgttctcgtgggggccaaataagctttgtccaaggggctgttgcaacggtaaaggtagtcgagccaagtgacaccagcaaacaaggaaacaaggaagcaaggaaggctttc

SEQ ID NO: 14601 - DNA, 470 bp, Saccharomyces cerevisiae
tatcctatgatttgtgttttagaggaaaaacaacagaagttgctttaattaaactgctactttccgataataaagcagtatatacgtaataatgtaaaaaaaaaaagaaaagggaagagtaactttatatatgattgtacatatacagtatacatgaatatatatatatatatttatatatatatatatatatacgtagccgtcggcaagatctcccaatttttttcgttcaccctatttaccatgcatgagactatgacaatgttatatgatcttgcttgcatttaatttgcgtaccctagaaaagaagaatccttagtgtataataaaaattgaaactataaaagagaaatgtaagagaaggaacagtgcccattgctgttcatgtccatacccatgtattcgctaaattcagtgattaagctaatggcataacgttgtcagcaaactcaccaatgacattaccagcg

SEQ ID NO: 14602 - DNA, 423 bp, Saccharomyces cerevisiae
tggcatcaataactttttattctatttttttttttttttcataagttatcctacctgtatatatgtatatatatgaaattcatttactgaatgcggtgaagaatgaagtctttcgcaccttcagtagaaaaataggaagaatccccatcgcggcggacataaagcaagcatacaaaggccttctatcagaacagcgattgcgaacttggagcaacaatggcgtcccaggttaacgccttattactgccggtcatagagtctacgccgcttcatcaaataaccaaggtagcattgacgaccacactcacaagtaaacaaagcgattacaagttcaaagaaatagccgtgccgttaacaaaatcactacaactgtacgagaaggcgcaaagaagacaagatttaagggcaagcttaaaagcactg

SEQ ID NO: 14603 - DNA, 436 bp, Saccharomyces cerevisiae
agaggttaccggttgatatctaaacaaatataaagaatttttttcatatatacacatctaggtacatactatctaagatcaaaagtactctattttgtcactaaacggaggaaggcgttcagttcgtttgtggttagtgaacagaaaaagttacttggagaaatttaattctatgtcaaaccactctctagaaacaacttccgatggtgacaagctgacatctccatacactagtggtgaaaagtatacaaaaaaccacgcaacagcacaggagacacacaccaagaagacggtatagggtttaacgtagaccttagggttccgttcatatgatgcacctgaaatatcctcgtctttctccaaatccaatgatttgcaatcactgaaaattacttcccatagtgctcctgagaataagcacgcgattaaatgagct

SEQ ID NO: 14604 - DNA, 444 bp, Saccharomyces cerevisiae
gcaatcttacatgtcaatttgaagtttaggacagtgaaatgcgtaggtattttgtttgtaagttacataattgtatataaaagaaaattttattttgggcagatttattggtactgtgcgctttcttgtctttccgaggacctgtgagtttgttttaccttcctgggccagtggaagctgctgtattgttcagtttaattagctcgcttctcatcttttctagttcttcctgcttgtcccttatgttcttttcgcatcttgtaatttctgtttcgatgaactctaatcttttgtccacgttggtacgtgcctcactttgttcaactggtaaaaggacattgcctgtcaatttgtacacaggtgtatcttcttctaattggtcaaactcttcatttacaatcttgttttcttgtaattgtgtctctaatttttgtctggccacaa

SEQ ID NO: 14605 - DNA, 445 bp, Saccharomyces cerevisiae
gcaaaggaagaggaccacaccatgcatttgtgtatcagcttaccctataattgcatatgtactcgactattttctacatatatatgaatagattccagaaccgaataaaggagaaaaaatatttgaatatggatttgttcgcttcacatctttaagtaacctagttttcccaatacgcaaccaaagtccaagtatgtcatgaaaagcctcttgccatcagtagcacaactaatcatttcaatggtcccagaactttggtcagccccgatgagattggagattttttgaaggtcttttacgcttaatacatgatctcttaaggccacttgcgggaaatccacgtctctgccacagtttctaataagcatcgaccataaatcatctattactgttaaattattcatcagtatcagtaactggcatgtgcatcgtaccagtttcgtga

SEQ ID NO: 14606 - DNA, 444 bp, Saccharomyces cerevisiae
ggagaaatcaaaggaaaagaagcaagatccagcgttttcttttgaaccctggaggatgctgatgcattctctatttatttggtatcaaattgtcgtacagatgatttatatatgttaatattgttcagtttacactaattttaatttaccgtatttactatccaaaggagaaaaaaagaagtatatggacttcagtatttatacaatatcgagttaagataagttaagtaacaaaaaaaactggatagagtggttttctattagtgtgacggaagataaaaacagccctctcgaggaagggtgaatgcatacttcgaagggaatctaattttgtttactggttttcttataagatggcaattcggtgtacttgtgatttttcatgtttttgaatttcttcatctccgagaacttacccaaaacacggcgtttcttgtttaaagc

SEQ ID NO: 14607 - DNA, 438 bp, Saccharomyces cerevisiae
aaatagggtccttaatgcatacgtattgatatatgtatctataatactatatacaattatctatacttccattactaatattatctttcaattttacatgtttttttctgccataaaaaagcaatatttttttgcgagctatttagtgatatagccgcccagctacttgtcgatgcatatattggctgagagtactaatacaattatcggaagacctcaaagtaaaatatagaagctttgagtaaaaggagctcgagttttaaaaatgacttcgtaatatgtaaagtttatgtcatatatacttacacgataaatagaccattgatcgttagagacgagcgcattgttttgttgaatccctttcaacagcgcgacaaaagttaatcgagaacaataagatgttgcattcaagggttagtcaaacatatcagaaggccg

SEQ ID NO: 14608 - DNA, 413 bp, Saccharomyces cerevisiae
aatgagaagataaatccttcgtatgtatatatgtatgtgtatgtattttttatacagatttcaatggtttttgtaagcatctgatacccatccacaatccctaaaccccttgttctttgctttggggcccttgacagggtcatcatatattgctctaaacttttcattgtgtgtggctggtttggatatgcaaacaaatttattatcaggaaggacacatttcaactgagatttagggaagggacaaggacagtctttctgctgtgcaacgcacgttagggtgtccggacacaaatacccatcacaagggttatttaaaacttgatcttcatatgattgttgctgttgctgttgctgttgctgatgatgaccgaaattgaagaaggcattcactccagtgctgccaaaaataa

SEQ ID NO: 14609 - DNA, 469 bp, Saccharomyces cerevisiae
gatggtttgtaaccgtattcttcttggattctctcttttttctcttcatatttaagtgtgaatcttgaaaagaatatttatagacatacgtaactagtgtacggctgatatttatttgatgtagcttttttttttgctaagttcatcgcttttctttcccagccaacccaatgaagtcttgcgcacgcaattggttgtaattatccgatcagccgctatcatcattgtcacggtcgggttcctgtaatacccttttccttattattcccttaattttttcattcgttttcttctcgagcacttccataataggcgctaatttggctttgagatcgctggtttcgcaaaccttatcgatgtaacgctgatgttcgtttttttgggggataatatatggctgaccactctctttttgtttcgtcttctgaatagtttcttgtacaaaactattcgttgcgttagagctctg

SEQ ID NO: 14610 - DNA, 400 bp, Saccharomyces cerevisiae
ttttctcttcttttccaatagcctctcaaaaattttgtcttttaatttaacatctttattactttataattcctcggtatagcaacattagatatataactacacatttttgtttgtagatatagaaatacctgtacattaaaagtggttactgttgttctgtataactatatgagtgaattttgtaaaaatatgcccaggtgccaatgattatattagaatatttccatgtgctaccctcgagtccattgactgtctatcgggtacacttaactctatatagccttgtagttccttttttaagttcatcaaggcagtctctgtatagtttatacgatcgatatcggtccccctactaacattgatgtatgcttttaaaaggaaccctccgcttgttatt

SEQ ID NO: 14611 - DNA, 431 bp, Saccharomyces cerevisiae
taagagaaatatattcttgacaagtcgatttatttagctacatatattaattatctatctacttacttaaagggcgatctccctttctttgtcttatttgtgctcttcattgttattgcccggtaaaatagaaaataacagcaaaaaataagactgctggcaaaaatgagcagagacctttctatcgagggaaaagaacaaactattaattcttttcgaaattccaacacgattaaaccatcatggcaagtctacctggtattgatgagcatactacctctgaagaattgataactggtgataacgaatggcacaagttggttattcccaagggcagtgattggcaaattgatcttaaagcagagggaaaactgatagtcaaggtaaactcgggcatagttgagatatttggcaccgagttggcagtagat

SEQ ID NO: 14612 - DNA, 494 bp, Saccharomyces cerevisiae
attatgagttcaaacgtgtccttttaagttctttttgtttcttttttgtatctgtattgacaatttcaccttctgtaactctatccttctgctacctaaatacatcagtttaagttccaactggtatttatttttcactatcatttttctctcgtttatatatatatacatggacatttgtttgttaatagaaaaaaaaaaataaaataaaaagacacttcacctaatttgctttattttctaagtgcagctataaatcattttctttgctcacaaatgattgaggtgttgtgcttatacttgcacccgttagagagttacagtttattatgcttatttaatttatttgctttatatagttattgtcaagtcatctgaacatccctatcctcttcaacactaagagattccaaaagctcatctgtcttcttccttacaaatgggaattctagaatggttgataggttacagctgatcaagcactctgcctccat

SEQ ID NO: 14613 - DNA, 412 bp, Saccharomyces cerevisiae
gttttattattactttttacaagttcaataccttctaattactttgtataacattccactcctctcttttgctttttgttacaatttgttatatattttttatcaattttatatctttattccttgaattgagttactcaaccaacccttttacggtctcacagtggtgaattgactgcatggcactgcattcttactctctcttgggcccttattcgtagtatttccgaagcttttttttccgagaagttcttccgattcactttctcgaagtttttttctagaacattccatcgaagatttcgaaaaaaaaagcttcgaggttttgacgaaatttcattcttaagcactatgggaaggtgtggacgaattgttatatataagccgcaattgggctgggttttctccaaaa

SEQ ID NO: 14614 - DNA, 494 bp, Saccharomyces cerevisiae
tctgcttagaggtgttacataaactaatgaaagaaatatcaatatctatctgtaagcatgaatgtacatatctcatgttagggttttcttatcgctaatttttcgcaatttgttacgtgggttgcttttatacagctacaatttttatatattctatcgtgtaatgaatggctcagtaaattcaagcgccacatagactaatgtacataccaatgcattttaattgtaagaataaaaggggccattcatctaccgtcttagttgaaagtgtttctgtgaattttttcaaattccgttttttcctttttatataatagcatggtggcacgagcatcttcgactgaagaatgctcaccttcttgaatggaaatttttaaaacctccctggttaatttctttaagctgggtgttttacccttagcatacaacttcctgaatgggaggtgtcttgaagtgtccctgagtagtgactttgggtgggataacatcaatgc

SEQ ID NO: 14615 - DNA, 408 bp, Saccharomyces cerevisiae
gcattgtatatgtatgtatgtattttagcttgtagacaacctttcacacttacatagtttgtcgctggtcacgtgcgacaatgcaaaatagtgtagagtaaagctaaaaaggacaagataaagtgaaaaaaaaataataaaaaaaaaaaaggaatattgttaatggaaagcgtgtaaagacacattacgctcctacctaggactaccaacacatgcatggatgccagtctctgtaataaccacggttttagcatgtctgtggctctcttataggctctataagtttctcactattcctgtgtccagcatcgtctccactttgaagatcaaaactccaccggcaacaaaagtgtctatcgacaaaatagccacggattcagtgaccattcattgggagaacgaacctgt

SEQ ID NO: 14616 - DNA, 422 bp, Saccharomyces cerevisiae
atttcctttctgcacctcttcccttcgttcgttttgttcttttaaatttatgtcttcatatggttattttttttatgtagatactctcacagatacattgataaacaattaagaaaaaaaaaaaacgcaaaaataaaaataaatcatgtgttatgctatctcttcttttctcttatattccctctaagacgctttttttttttttttttttttaagaataccatattagacttacataaggcctcatcggccttctattttaacctttacaaatctataaaaaaattcacaaatagtcttttttattggcagtccttatgaatcttctcaactgccactcaacatcagcgtccttattttctaaagttcccaacctcagttcaaacaacctcatctcaaatctaggaccaacttcggcaatc

SEQ ID NO: 14617 - DNA, 446 bp, Saccharomyces cerevisiae
caaaagtttgcgtataataaaccagtatagatgtgtaactgtaatttttaacttatcacaagctcgttcccttcctgcgttgaaaaagcgggacaatgccagaatataaaaaaaagaagaaactttaaaccctgtcatatcttgtccgagatctcgtcgttcttgtttaattgatcttcttcgtatactgccaaaggtgccaaggcacaaaaaagtttaaagtggcacgggctattgcgtcacataaagcccgtagcgcaaaaaagtgatagctgacttcattagatcaccaaaatggaaaaaacttcgtgaagatttctttttatcttcctcacagtttttaacttccgggtgttatactctccgtttgaaaagttgattttgttaactttcctctttccttttggagtaaaaacaatatcctcgataggcaagaccttcctgca

SEQ ID NO: 14618 - DNA, 490 bp, Saccharomyces cerevisiae
ttctagtaaataatatccagcatacataagcttatctaataattagatcattttacaatgtgtaccgagtaatacaaagttgaggggggaaaaagtgttataatgctcaaaatacctgttcaaagaaatcaccacccaatttcggaaagtcttactccattggaagcatgactaatagattcgattgatacaccacccattaactctcctaagtcactagatacttccaacaatttgctgggattgtcaaagtgagtggtagcctctactactgcagtggccaaccttacaggattagatgatttaaaaattcctgagccaacaaacacaccatcacaacccaactgcattaacaatgcggcatcggctggcgttgctacaccacctgcagcaaaatttactactggcaacttacctttttctaaaacatctttcagcaaagaaactggtaccctcatttcctcagcaacttttgcaatgtcatcttcgc

SEQ ID NO: 14619 - DNA, 484 bp, Saccharomyces cerevisiae
aagcaaagtactatcaattgagccgcctttctgctttttatttatgtttatggtaagtatctgagccttaattgaaatagatatataattacaaaagattagacaaggagaagcatacgtatattctatttcttcattaaggttattttattctatatctgctacactacattaaatacagatacctctatggaacggatgagcgtttattatcgcgatctatatatgagcagtgattattttttatttcgtagcctgctggaaactcttgtggcaggagggctatttttacgagagcctgccttccgccttttccttttcggcgaggtttcattgctagtattacctgtggatgatgaatgcctagttctctttgctaatggttcatttttgtccttagaatcctttttggtatcatcctgttgatcatctccttttttgttttccgtttttttctttaagttgcccccttctgattcaattt

SEQ ID NO: 14620 - DNA, 469 bp, Saccharomyces cerevisiae
ttgaagcgcaccaacttaaattttacgccactttcaattaagaatataataaatggacaccgtgaataaattagggaaaaaagaaagcaaataagaaaactccgttttccctcatccctttccgtctttcggaagaaacaaaaaattatacccaaggaaaacccgaaaaaaatgaaaaaaataccagaaaaaaaataacaaatcatatgcacttcttcattaacgattatgaagaagtcttatttctaactaatattattattattattattattattatcattcaccccgctttcttttattataatttgttcttctaatattttaatttttaatcttttcatactattcttatatctaactaaagtatccttctctttgtctagttttacttcactacatacctgttgcgttgatttgagttttttgtatgtaagttctgtttatcctttttcatcctaccgttccg

SEQ ID NO: 14621 - DNA, 480 bp, Saccharomyces cerevisiae
ttattttctttttctatccacttcattaacttattttacagtttgtatataaaagtattgatgtatttacgcgacaaaagggcttgaaaagattcgattttctattacttgatctactttttcctataaaataaatcctaaatgaaacgtgtccatacatatattgagtgttgacgcgtgtgatttcacattatgttgtggcaggaagtatgttaatcttgttcagcaattgctactagcctttcttcgatgttctcagcactcaaggtaaagaatttgtcctttgtagcgacaccgacttccaagtcattctttgaaaattcggtacccagtgcgtcaatcatatgagtaatagcaaattctaccaccttctcccatgattcttcattaatatggtcgattttactctttttgaaatggttttctaagtttgttgtgatctcctgttgttttggtcctgtcgcagtagctttgtagcca

SEQ ID NO: 14622 - DNA, 427 bp, Saccharomyces cerevisiae
ggtacagtacataaacagatgaattttatcattcttattgttatttctttgtttacaaaaggtgaaaagtgaaaaatttcgcaatggaaaacgtcgcgggccgcctttgagtgacgttgtgcaggaatctcgaagagtcatcactttgaagataacggccgctcgcgatgagagaagacaatgagcattgcttttttataattttttataccttgtgttaaaataagtttctttaattagttttcacctcttggatgatacaactgtaattgataaataggggtagccataaagaacagaaaaaagcggcgcaataatttcgtgtattacaattacagttagtcatgagtgaagaatttcctacgccgcagcttttggatgaattggaagatcaacagaaagttaccacgccgaatgagaagagaga

SEQ ID NO: 14623 - DNA, 482 bp, Saccharomyces cerevisiae
tgaaaaaccttacccccaaatgtagtgctttggtgcgattccagcatcctgtgatgttcacctacttcaaggttatataattttgtgtgtagaattgtaaaaaggatggatagacagttcttgagataaagcacagttattttggtatcacatcatcggagtatttttcaattctgattttttgactggacccaacaaacaactccaattcatccaattgtccttccgtaggtaaacaactggaaataggtacacttctttctatcatcaatacaacaatgttagtacgagagacttccagatcaggtataacgatgcccccagatggacatgtcctatactcttgacattcataaacacagagagctgattcaggctcgaaaatattacatcgcatccttaatcgtgctgatgattccacgggtactacacgtataaaaagtttgttcgtagaatactttttggttggcaaagtcatctga

SEQ ID NO: 14624 - DNA, 412 bp, Saccharomyces cerevisiae
aatatgtacatgatctttaattctgatatatttcgtatgtaattttatctttaactggtgattcttttaataaataaactacaatattataactattgaaagcctctgttattcacacatctttggaaaaaaaaaaatacaaatacccagtgagtactaagtaaatttggagtacctaagggcttgtatcggtggggttcctgacctagctttatgttttacaaacgcatgcatataaaatttacaaaactacaaaaaccatgaacacaatgaaaagaaggaaaaagagtaggtttgtcgtgaaagtacacgcctctgaagttttgttatcatattactataatattgttacaactcttaggaatcttatatttaatggataaattcctgtttcacgacaacaaatgcgaat

SEQ ID NO: 14625 - DNA, 468 bp, Saccharomyces cerevisiae
ttatttcaaatttttcatgtccttgtatttttattctttatcccttccaatcagaaaggatctagtgaacaagttctttcctctatggtatatattttagtgataaattttataaaattatcaaaaccaaggcatcctttccttttattctgtcattggaatctgcctgtcataattatcacccaccgggtaaagatgataatttttcagtcgctttgcccgagaagctttgccaggtgaaaaatttttcttggtgaactaaatcgaaagtagatatacttacaactatagagagagttccaaaataaaccatacaaacgcccaggaaacatcaagatggcccccccaccattccgtcctgaaaatgccattaagagagccgatgaacttatttctgttggcgaaaaacaagctgctttacaatctttgcatgatttcataactgccagaagaatccgttgggctaca

SEQ ID NO: 14626 - DNA, 402 bp, Saccharomyces cerevisiae
cgttaagatgtcattctggttaaggttatacacatatatatatttttcatttttaatgtcttagcttttgtatcttagatgaagttttagttctgtatatcacgatcaagatatcatacaatcataaattcaattattcttctgtttcccctcttgaggcatcaaacgagtgtttgactgatacacaccaacatactaaggcaacttttctggctgcccaaagctgtggcacgtatgaaactgcttttcggctgcataaaacaaccatgtggagtttttactgtattcgcatttcgccccgctagcattcttcgttcatgctaaaaatgaggcgtgggctaatattcagtattaataattccggcacccgcacagcccataccggaaaaggggctggctgtt

SEQ ID NO: 14627 - DNA, 472 bp, Saccharomyces cerevisiae
aactactcgtgcgcattttattttatggtaaatttaggttttcgcaaatttataaaatcttcatacaattaaaaaaaagctcttttaagataatagtgtctgctcttacaaacgacgaacagtaatattttataacaaaaaatggaacatattaagttaagagaaaatcatgctgaagcatgaatatatgaatatacgtcctcttgtaaaatagcgaaatccttgtaagccaatagaccgaactctattttgatttatacgcttcgtgtattttttcttccagatccaggagaaaaagcatggtctgttcttcttttttgaaaagagaggcagtccacggcgaaagtttcgaatacggcactaccttttttttctaagttcctaaacttaaaatcaaatttggtctttggtctgttatcatccagggatgaatgcaacatattgggaagttcatgctatacaacgccaaccc

SEQ ID NO: 14628 - DNA, 487 bp, Saccharomyces cerevisiae
cataaataagaatatgataagttctctatataactttactttatgactttccctatgaaatgttccaaaaaagcacatagatttttagtacgtgccttttattttatgtacttctgataaaaaaaagaaagctcctaaggacaaattacaatcaatggcgaaagaagaggaagaaagtaataacgaggagagatcataaacatggcgtcagtaacagaacaattcaacgatattattagcttatactcaacaaaattggaacacacatctttgaggcaagattcaccagagtaccagggattattactttccacgatcaagaaattattaaacttaaaaacagcaatttttgacaggttggcattgttcagtactaatgagaccattgatgatgtgtctactgcttccatcaaatttctagcagttgattactatttaggattattgatatcaagacgacagtcgaatgattcggatgttgctcaaa

SEQ ID NO: 14629 - DNA, 435 bp, Saccharomyces cerevisiae
attcatacctttacgactaaagcagcaattggagggtaaacttattttttccgataatgttcttggcaaatgagttaccaataaatgacatgaattacagaaaacaagaaaatatttgccaaaaaaaaaccaatacaaaaatataggggaaaagattatcctttattcctttctcattccactttttttttttgttatatgcgtattctgattgattcataactaagtatctttccttttcttttctttcaatttcttttttccatatataaatacataaatttacataccttatgtagtataatatatggaagaatgctactgaacacatcagtacacatgctatgtacttacaatcttagtaaggtagatgtaggtctaatgcttcgatgatcccttcattatttcttgggtataactgtcagtctcgcaccg

SEQ ID NO: 14630 - DNA, 457 bp, Saccharomyces cerevisiae
caatcagagtaagaatcatgatgacatttaatattaatttaatttaatttaattttttgttttgttttatttcgttttgtttttttgttcggtattgatttttcttcttttaatcctcttcaatggattgaaaaatatatattatgtagagtaaataaaagacctcttaaggataaggggtaacctgggatctggttacagttcaaggcttcgttattagggagcgaacaataaagattaaagggtactaaaaattgtactattactagttgcatgttgagatatgaagactttcagtgtctaaatgccccatgtctatataatcgcatgacagcggtgtatttctatctatttaccttaataaccgctttccgctaagccacagtgcaatcgtattctgcagcagctcttgccctgcggccttttatgaagctttcgaccatgtaaagcccgctaa

SEQ ID NO: 14631 - DNA, 494 bp, Saccharomyces cerevisiae
tttttttaaaaccattttttattctcgtctgtttcgataaacagcgcttatataagtataccttccttcattatttttatttttttcctagaaaaaactatatgtaaatttactttcccacccaatcttaggcacctgccttcacttttgccaatcttgtatgtatgtgtcctgagggacctattgtatgcaatacttttttattgtattaaggttatgtgagtttcgtcctgtaaagttgatcggcgcatctacacgccgccgatcaactcagcgatgattctcttggcatcgtccatctcgaaggaaagaacttaaagaaagctcaaaaggatgttgacgacgcaattcgaacagaaggcagctttcggcgaatatcccagaacggaaataaccgggccttgcgtattttccatatgaatacgcgcaagttcaggtcatcttgtacttgttctaatgaaagaatcacggcacgttactaattagcgggcccc

SEQ ID NO: 14632 - DNA, 450 bp, Saccharomyces cerevisiae
tgaatacgcttcaagaagataaaagtataaataatacatattgccagcaacttagtcacatatctcttttatctctatttatcctctttttattaatttatgaccacgatcactatatttagttcgaaagttagtgtttgttttgccaagatatcctcgcagaaacagttttacttaaagtttcaggtgttgcgtggaatgcccctgctaagctgtcgtgtcgcgctcttccccgcgtttgtttcacattatatatcatatggcgtatgacggtatgggtgaaaataagcgtaggctggttgtgtgtatttctctcgcactttgaaagggaaaaataaaaatagagtctattaggaagctcacatatgccgggaaaaattacgtaaagcatcaaaagggaaagaaaatatagggaaagataaaacaaaaagcagaacggtatcaggcatt

SEQ ID NO: 14633 - DNA, 445 bp, Saccharomyces cerevisiae
acacttgtgtacactattacatatattattcaataataattaactgacgcaatctatggcactggcgtggtttctttttcttttgttttccgtgcaagcgcgatgcaactatatcgtcgaggacgaatgtgtacccgtctttccgccagacaggtaacaagtacttcaattgacttagaagaaaaacattaaggaactttaacgtaggagcaacacaataccaggcacacgctcttcgaacactgaaccacacgcgtccgcatcaaactcttcctcccaaacatgaattggctgtttttggtctcgctggttttcttctgcggcgtgtcaacccatcctgccctggcaatgtccagcaacagactactaaagctggctaataaatctcccaagaaaattatacctctgaaggactcaagttttgaaaacatcttggcaccacctc

SEQ ID NO: 14634 - DNA, 407 bp, Saccharomyces cerevisiae
ttcgactaaggttgagtaaatttgtgcaatctcgttatatcatatcttggaagttatagagggaagggcgcaaaaataaaccctttcctcttttttacggcgaccatactctttttttcctaatccttttcaagtttaaatccatgatttaatatctatttatacatataaataatataagtaatggtttaatgcattgtttcaaaaaaaaaataaaaaaaaaagggaagaaattatatataaatatacttcttcatcttcaaaattcaaaccgattgttttactggttagaatattatgtgtgctctttctttgctctatgacatggctctgttttgtaccttccttttttttatgctattgaataaatttgttgtagccgctttcctcaggaaggaccccatgta

SEQ ID NO: 14635 - DNA, 469 bp, Saccharomyces cerevisiae
tatcgtaagctaaacgaggtgtatagttttgaaagataatatatgtaggtatatgtgtacataaagtcacaaaagtgatgtaatttatgaacacctgtttactagcattatttattgtcttgattattgagctagtcttttagtttcaccaaacatttagcaacatggcgtaaacctctgaacaatagttaactaattttgcatatacaatgaatgtagccagtaatatttaattatttctttaattttttgcttttctttggaacccgcaccagccagtataaaaatattgctgcacaatagtcaaagacaatatatgcactaaaaatgccatagttcatccatctacgtgaatacgaagaactcacagtcgccagataatcattggtagaactgaattgacaaaagtgacattcagtttcggaactcccatcgagcagataacccgtcccggtggattgcatataag

SEQ ID NO: 14636 - DNA, 483 bp, Saccharomyces cerevisiae
acaagatcacagaaaataaacctcacttcaatatatatgatgtgtaggtagggtatatacttataccactgctgtcgacagtgtactaacctatttcctattttgtaggtaagcttttcagctactggttggtcaagttgggccctattaaggttgtaatcagcttattcgtttgaaatgatatacctcttggactggaatcttctggaagttttttggaggttagaaaagaggaaggcatctcgcgctgacagaaatttgcttataaaccagcgattggctatatctaaaagagcactcatcgtcagtcagaaagccattacctttcaacgaaagagtaaaatagaaaaaaaaacacatacataactatggaaaagctattacagtggtctattgcgaattctcaaggggacaaagaagctatggctagggccggccaacctgatcctaaattgctacagcagttattcggtggtggtggtc

SEQ ID NO: 14637 - DNA, 493 bp, Saccharomyces cerevisiae
cagcattgacgatagcgataagcttcgcgcgtagaggaaaagtaaagggattttagtatataaagaaagaagtgtatctaaacgtttatattttttcgtgctccacattttgccagcaagtggctacataaacatttacatatcagcatacgggacattatttgaacgcgcattagcagcatgatgactcacacattaccaagcgaacagacacgtcttgttcctggatctgactcgagctctcgtcctaaaaagagacggatctcgaagagatcaaagataatagtatccactgtggtctgtattggtttgttgctggttttagtgcaactggcatttccaagcagttttgcattacgttctgcatcacacaagaagaagaatgtcatattcttcgtgacggatgggatgggacctgcgtctttgtccatggcaagatcattcaaccagcatgttaatgatttacctatagacgacatcctgacacttgacg

SEQ ID NO: 14638 - DNA, 447 bp, Saccharomyces cerevisiae
gggtataaataaattgaactgaaagaatacatattgtaagtataaggaagtatgttaataaaatttttctttaattatgtaatacatggcatgcaagcatttcttctttttgggatgcttttcctcttagtatcctatgtttgtatatatctttttgttaaatgacacgagagaaggagacaataggataattttgaaatttctgtatcacaatcgtatctagtttcttctctacacctttgttttgacgcgatgtttcctcttcaaaaagcttcccaagcaacttagattttccaatctcctgattatttcgtttttctttagaagattttttagaatgcctgtgcaaagagtgataatctttaactctcagggaatggtcgtcacaaaatctgatatataccgaagagacttcttcttctacatcctcttcaagaacactaggcc

SEQ ID NO: 14639 - DNA, 410 bp, Saccharomyces cerevisiae
aacctcttttgaagtatagccatgcatataaatatatgtgtgtgtaagaaaatattagaagttttcataatctagaaatgtcaggctttgggcctaatggcactataccaaactgattgatcttgttcctacttacttccatcctgatgtaaaagagcttaatatgattaaaatctgtagtaaatctaaactctgcgtaattccagtatagattaatcaaccacaaatgaaggtacgggaaaccatcccttatagttttcaaattgcatttgaagtgctgcacgtacacgacgtcaaatctaattattgatggatacaatctgatatccgcttcagttaacctctgtcctaaaacaaaatatttagccaagattttctgtttgttaccactgaattgctcctctaagcgc

SEQ ID NO: 14640 - DNA, 416 bp, Saccharomyces cerevisiae
accagtctttaaccgccataatggcttttcttttttcttttttttttcacccccccctcatctttgagtgagaagcttatatgctttacttttcctcacctactttttaattcttaattattagtttatccagcattcagtcaattctgaatgcgttatcgcttcctcaaaatttataaaaatgaataagcaagatctcattggaattgagttcaatgacgattattgagggcccatacctgataaaagtgaatatattatgtataatgactctactggaggttctctctgagaatgtaaaataatccacaaaagacatgaaaattagttactctacataatgtataataagttcttccttccttttttctttttttagtttttctactcaccatcctacctacgccaagctgctc

SEQ ID NO: 14641 - DNA, 465 bp, Saccharomyces cerevisiae
atgtatataagaatataacaagaaagtcataataaggtgttttgattgtgttcattgattgatatcccatttgtcactcgtacataattaactatctcggaaaaactggtttgaaaatcttttattcatccaccttatttaataatatgattacaatcaattccttgggtgcataaaattacacctattcttgcttctctttctcgcctgataaagttgttttgccttatatgtttatagtttttaatatttatttgaaggccacatggggcctctttcccccattggttgaataagtatccctgtagtgcgcctaaaatgctaaaaataataatgaacctacacctagcatacccgcagaaatataccaaatggcattggaggttaaaaatgaggtattttgtcttttaatggcattcgtcttgtgtctgttttccaggctcctcctcactaaacttctcagtg

SEQ ID NO: 14642 - DNA, 425 bp, Saccharomyces cerevisiae
ttgcttataatgaaaatcacaggtataaggtttgcagaatgccaacagtatatatagatggcagttcctatccggctgccagagcgaacaatattaagaggatatgcgtcgatactaattgaatgttcatcctgcattccttagtgaaactttcaaaatatataataacatagttatggtagactatatatcccagtcaaacttgaatgtaatgtggagtgggtaatcgatatctcttgaagtttattatgcctcattatatttttataaaaaacttctaggaatttgttgagtcaaataatttctttcttaatcattaagtaagttaaagttacgagcctttcagacctgcgtagcactgcttcaaaggaactattatcaatagcagcgccttgctcttttttttttttcagatgcttagcggc

SEQ ID NO: 14643 - DNA, 476 bp, Saccharomyces cerevisiae
aaaaacgcatgaagtggtttacagaggaagtacgtagtatagtataatatagttcataaatctatattctttctaaacatcgaaaacgagatttttttggacttccgtctttttttttttttttgacttgaattctattaatatttatagctgacctgcgcaccaactttatgatcgttggtagagaatgttttgaattgaactacttcaccatcaggtatctctttactattggagtcggcccattctaacggaactttagcatccgcgtctgtatatgcaagtactgtgaatgtgtacccaccttcttttgttagttcgggcagaaaggtaacgcttgaggtgatttgcctgattaaagctctgatttgtgattgtgttgtatttaaatctacaacatcatcctgcccgttgctattgccagaaatgtgttgcacattgaaggaccatctttccaccacctctccctcatcctt

SEQ ID NO: 14644 - DNA, 433 bp, Saccharomyces cerevisiae
accaacgataatgtaactataccaagaaacttagtatgatggaattttttcaaggagtcgtaaattagattttcgcaggtaataatgcgatatataagcaatctcatttaaatatcgacggtggcatttataccatcatttactgttatatttatctaacgcgtcgcgacgcgttagataaaatacaacaagatttttttttcgtgtcaccaatggcatgaaagcttcgagaataatttgaaggaaatttcacttaatgggaaaaataaaaatgtacccttatcgagattactcttttaccctcagttcaattaaaattcatcatgaaccaagtaaaagttcctctaattacgaacgagcaagcaaattagtattgtgtgggagacgggatggaattatttaacaaggaagaagcgagcttcgagactctgtt

SEQ ID NO: 14645 - DNA, 460 bp, Saccharomyces cerevisiae
aagcccctgaataccataaatagatacatacgacatataaccatagaaaaaatagtaatacgatggtatgtgtgtgaaaagaaaaaaattacgtgacgcgacgcgtttgtttacttttttccattttatttccatggtatttttcaaatgattttggaaaattattagatattgttgaaaaaggaggaaatgagaaccctttatagtcgagagtaacaagtaaaggggcttaacatacagtaaaaaaggcaattatagtgaagatgagtttgtccacgaaaagagagcactctggtgatgtaactgactcttcattcaaaagacagcaacgaagtaataagcccagctcagaatacacttgtctgggccatctggtgaacttaatacccggaaaggagcaaaaagtggaaataacaaatagaaacgttactacaatcggtagaagtaggtcgtgcgacgt

SEQ ID NO: 14646 - DNA, 400 bp, Saccharomyces cerevisiae
tcagaacatcataaaataatagcaacatttacatatttttatatagatatttttctttttttaaatttctctgttaaatgtgatcagataatcgtagtgcccaaggtattatcagtagtaatgggaaaacattaagagcaccactatagactatcgtctactttttcccatgcttcaagtatcctttcgtagaattcgatatgatggtccgctagtgagcccagagatttcttgatttcagccgtttttacactttcgaaatggtctatttccttcaagcattcctgttcgaatccatccgccacctttttagcgttttctaattcacctgttaatgacgttattttgccttctagtttattgattttttctctacgtgaagcctcctgatttattcccg

SEQ ID NO: 14647 - DNA, 440 bp, Saccharomyces cerevisiae
ataatagttaatattctccctttttattatgctcatatttatatggttttgtaaaagctattacgtagtttatcaatttgtttataattttccattttcaatatttctaactcactaaccaaatagtttatttgagataatatcctccagtcctccttaaccaattgacgggctttccagttgaaattcgctatcacggtgtccatgtaagaggaaacttcttcattacttttcatcgttagttttattggggcctttggataatccaaaggtatgttgaataaaattttcaaagaaatcttaccggagtctgtcatgggggagattcgatagccatatgaggtaacgtgcttaccctttttaaacagtttaaaatcggataaggtgtgaatgcattgttcgatttcttcttgcctttttgcgatttgttttcgctcttc

SEQ ID NO: 14648 - DNA, 480 bp, Saccharomyces cerevisiae
attttacggagtgaagactaaccacttagtctgccaaaacattattgaaggatatccaacagatgtaattgacgtactaaacagagaaataattaggtaaatagagtaaagatatgtaccactataaattgttatttatttgtttttcaattttaaatacagtgtatgaagcctaattcggatattataggttcccatatttattagaaggtaacaaatctttcgataatttggattagatagccttataatatgccggacaaacgacgcccgctaaaaatgtgtattctccagtattcaatattcgtcataaatgatcttaatttgaaaaagtgaatgaactgaacatcgataagtcgaatgtggtccgtgtaatagctcaaatgggaaagtttttctaatcagcattctgtataacctcacctgcacgtaatctaaagtgcttttatcgattggtagtgcacatattgtctttcggca

SEQ ID NO: 14649 - DNA, 447 bp, Saccharomyces cerevisiae
aaaagaggaagttcgaaccatttttttttttggtcttgtgaagactacgctctcattttatctatttttttatgtgtatatatgatttaaaaaaaatcgatgtacttatgcatttaaatcgttcaatttttttgtgatagttcggtctcttctacgtatcgtccaatggatgaattaccatcaaggatgagttacctatataattacaggttgagtagtcagtgtccatatagaaattgtaactttgataaagaagatcttccgtagtaagatcattcggacaggaaaattgaaaatcgcttgggcaatttcgtactaatgtatagcacatgtcaatacaaggtagaatttcgtaatagtcatccaaaggtttaataaatttattcaaataatcattacggttgtgacttttatctctgtggatgtagtattgggaagacgtcgtgg

SEQ ID NO: 14650 - DNA, 486 bp, Saccharomyces cerevisiae
ataatgtgatggttagttttcataagacaaataaatattgtaatgtaatcatatttcaataattttctatttggcagccaatagaaaagcttgcgcatagaagaaaactaaaagtaaaaaaaaaatagaaatgttcaagacaggttcaataaatagatatttagtttttattactatattaatttagtagacttctaaaatgtatcttgatgcttcctttaattcttcaattgcggcatccaagtcgactttgatgcctctttcctcggcgtctttagccagaatgtcttgcaaagcttgagtaatatctggaactggccaagtagggccacacaagtaaaatgaacctttattatcaatcattgcagtttttaattcatccaaattctctttgatacgatcttgaatgtaaattttttgaggttggtctcttgagaaagcagcgccgatgtgtgtgataatacctgcatctttgtaagcctccca

SEQ ID NO: 14651 - DNA, 422 bp, Saccharomyces cerevisiae
tgtaagatatgtcataaatactgtataagtcacacaaaaagctgatatttaacgcatcttagtctttattttctttgttatttattttcatttaaaacaaactttactgttttttttttgtttattatttttagtatacaactatatagataatttacatttattcttcgtcattaaatttaggagccaagaaaaactgtaggaacccactcttcaaatcaaattggaataaagcaggagcttcgctggagagcctgataccaactctatcagaaagggaggagcccttaatgatgtccaataaatatttagctccgaacgtcaagtcgacaggttgatccatttcaagtttgatgcttgtttcaggatgttccatatccacgaatggttttattatgactgaacctgatccgatatcaccg

SEQ ID NO: 14652 - DNA, 442 bp, Saccharomyces cerevisiae
ggtaagaaatagagtgttgtatgatgataaaatgtacatttgtatttactgtttgctttttttctttcttgtttttctactctcctttctaccaggtattctaactctattatataattaaaaaaaaaataaccatatattttgtattaagtttcatacatgtgttcaagtgtatttttggatttatcatttttctatgtgaggtaagtttttgaatgtcccattttcctttcgtttttggaaagttctaagaaaaagcattaacaattaaaaaaaaaaaaaaaatctaaataatactgatagaaatatcaaatataaactactaatatcggtaatattcaaaagaagaagcatgactataagcgaagctcgtctatcaccgcaagtcaatcttctcccaataaagaggcactcaaacgaagaggtagaggagactgcagcg

SEQ ID NO: 14653 - DNA, 441 bp, Saccharomyces cerevisiae
aaccaccattcattgtggaaaaagatgaaaaaccattatgtatgtcattaaaataagtaggtagggttttataaactattcaaatatttctcatatactcgctagaagttttagcaaccctacaatctgggggtatacagtgtgaaaggccgctggaacatgtttgaaaattgccatcaatgacttatattttttcaaacataagagtagcagcagacctgtgagcagaagtccgtttttgttcagcacacttcttgtgaaatgatgcttcaggacagcccaaaatgaaccagccagaacagtaatatcattgttttttttacggggcgccgttccagtactctggagtctactatcagtagaggtgcgttgattaaacgcatcctcaaccttaacctgttcttcactactattgtgtaacataggctcgtgaaaatggtg

SEQ ID NO: 14654 - DNA, 479 bp, Saccharomyces cerevisiae
tttctaaatattcttgtactctggtaaacagaaataacaacagataatggattgatgctttacttctatttcatggagattggttttatataatagcctttattaatggcgtcacaaattgaaaaaaaaattaaaaaaaataagacggacacatttgcgacgccggtgaataaatgcatataagtagtttataagctagctactactcagaaataatttcaaaaaaaaaaagaagtgggcactttaaaatgaagattagctatagtaaattactgtagtataacaactacctgctatctttctgaaaaaatcaggcaatgtaaggtcaaacttgtaccatcgacatatataatgttttgagatataagtaactagagaccagtttatacaggatcttacctctttttaccgttatgaaagctttattactgcgttgttagtaaacacacatattattttcgggtagtcctgtcgatgtt

SEQ ID NO: 14655 - DNA, 485 bp, Saccharomyces cerevisiae
aggagaatatttcaagatgcctcatggtgattttccgataaaagatacaagaaattctcatagaaatacttataaagatcaataaacagcaaccagaaatcacgtcgcattgataatttgcctcgtatatatcgtataattattgtaattgcacaactgtttttgttttgtattcgttcattttcttgtaaaatgtttccacattttcttgtggaggatatgtatattgattctttacttattcgtgttattttagctgcaaatatctgggtttgagggctatttgactagtctagagaaaagtagtcgtgagaaaactatattagatagatggatgagaggagcaggtcaataagtaaaagaataataaataaatatataaaaatatacatgtaaaaaaggtgttctaaatgaatgataaagtttatgaatgtaatatactctaaggatgtaagaaaaaaaccgttgcgtatgtataataaaca

SEQ ID NO: 14656 - DNA, 499 bp, Saccharomyces cerevisiae
tcaccaaataccccttcatctcccaatacattcaatacagtcaacaaattttcattctcagatatatgtatccatatatacactaataatatcttactaaaaacttgtctatttccttcttcaaatgtcagttttctttttattgaatatcaaaaaaatattatatagatacatttgtatatgtcattatccatgcagaagaaaatacttaaatacttaagtacacaagtatttattgatttgctatttcggtcttggcaagtcccttggctacgtcatctacactcgcgtcatcctcttccatatactcgtcgcctgtgcccaccacgccttgttcaaacatttgcttaccggttagcttcccatgatgagccttcatccttctcacctggtctctttcatccagtttcagttcttggcgaaatttagacctccattccaagtacgattctcttgtgactttagtaccatggaacttggcctgttccttcttttcacg

SEQ ID NO: 14657 - DNA, 437 bp, Saccharomyces cerevisiae
cccattatactttttcagctttcaacctatcgggacaaaaagacaatgtaacgttcaacatgtaataataaaatcgttaacgacgataatgagcgcagttcttttaaaataatgtgttttttttttttacattttcctttgtcgaatatataaagtttcttcttctgtatgtaaaagtatttttattttatgttattgaatttgtttttttgttatttatgtatacgcgactatctatcagtttggtacctcgaacaccagagatacaccttcatcacctgcagttattacttttctcttctgctcggtgccggtatttgccacaggatgcagtaatataaaatcaagaacccccatattatggcccacacaaacaaacttctcttggccagttcttgcattaaactggtaaaccttaccattgatacacgatgcga

SEQ ID NO: 14658 - DNA, 453 bp, Saccharomyces cerevisiae
tgttaatcctcttttaaagtactcatatgactatacataccttcttttcttttctttactattcaatacataacagaacaaagatgcaggaaaatattggtatttgttcggcaatttatgctgggtttttttgtaaattcaggtctaattattactgttgatttgtatcaagttggtatcttttttgccatttaataatagagatacgctatgctcatccggatagcaacaatgagagcctaaaagtcctaattgagaagaaaatctctgttcaagactatagtttatgtttcattctggacccttgggatcgtctgaaacaggaaggtcaataattggtaaaaaaaatggtaaatgcgactaagtactacaattgaaacgaatgagcgcacttcatcttcctacaaaacgctgcggctgaaaaagttacataaaaaaccgtcctcaatagcg

SEQ ID NO: 14659 - DNA, 491 bp, Saccharomyces cerevisiae
attttagttactttttctatttaagttttatatgacttcaaaattatttcttaagatacaaaaaatggatggaatcagactaaatttcttcggattatccgtacttttctcatttttttgtttcaactggcgattccatatttgtttatccattgcatacaacgaaggcttacggttatacagtctaaagctaaaaaagatagtaatatgtcgacagcacagaaagctaagatattgcaactcatcgattcctgctgccaaaatgcaaaaagcacacaactgaaatctttatcatttgttattggagcagtaaatggcacgacgaaagaagctaaaagaacctacattcaagaacagtgtgaatttttggagaagttacgacaacaaaagataagagagggaagaattaacatattgtctatggatgctggtgtttctaactttgctttctctaagatgcaattgctcaataatgatccgctccctaaagt

SEQ ID NO: 14660 - DNA, 446 bp, Saccharomyces cerevisiae
gcttctgcttaatttttatactaagatctatttctttaaatgaaaactcaataattagagaccttatataataaccaactgcaaaaaaacttctaaacaattagttaacaaatctccagcctttttttaatatatctttattcatatgtaacgcctttgagtgcttacgggaaaagtagaattgatagtttcgtaattcatgaccggaaaaagtgaaaaattattgttcgatgaatatatacagagatgtcttgaactgtttttgccagcatcattcgttatagggagcaaagttagtgcaacccagttaccagatatctagtcaccaagaagaaaacccgtaaaatcgtaggtcatggtcgaagattccagagttagagacgccctcaaaggtggtgatcagaaggcattaccggcctctttggttcctcaagcacctcctgtct

SEQ ID NO: 14661 - DNA, 490 bp, Saccharomyces cerevisiae
gtctggacacaaagtatcgtttccactaagcaattgtcaaagcaagaccaaagaagcctttcaccacggtcggggtttttttacatataaagataataatagattaacttagtacgtagtctcacttctcattcaaaattaaaaaagacgtggcttccaaatcaactaataaccccgcttaattccgccctccgccggggaataaacggagttatcccctgttgaaaattcagcatgattatgtatcacaatacataggtgttcgtctataaaaagaactacttattctggataaactttcgaactcgctcaaacctatttgtttctgtacatcgaatagacccataatcacttcttggttccaaaaagtaaagtaatagccaaaaatgtccccattgaacgtcggtatagttggtacaggtatttttgccagagatagacatctcccatcctaccaggaatttcctgacaaattcaaagtcattgccgc

SEQ ID NO: 14662 - DNA, 445 bp, Saccharomyces cerevisiae
gccattagtagtgtactcaaacgaattattgttgcaaataaataaacttacacagtttgaatacataaatcaatcagacaaataaatacatcggttcaaattatactaaatctaaatactacgttatcgccgtgaattacgcaattcgcatgttacgtactgcgcgtctcttgttgaatatttaccaattgggaaaaagaactcgtatttcattcccctttttggaaaggggtggggagagactgttgttcagccacgtcaattattattttttctttggccctgcgcttgtcttataaaattccgcagccgcctcttatttttttttttttcgatttttggcccacaggtcatattgcaaaaaccgaatggccgcgcccccctcacgcacgggacggaagaagggcggcgtcccctgtttttctgctttggctcatctctttgg

SEQ ID NO: 14663 - DNA, 473 bp, Saccharomyces cerevisiae
catgatgactgaacaaagcttatacgtacgtaaagtaatttcatatatatgtatatatatgtaggggaaataaaacaataaactcaacgtgtacacttatgcttatgcattctatttcgctttggattcatactcctgtggggtctttagtgacaattgtaaagcatggataccgttcgcctgagccatctcgtcttgcaagagggaataaaccatacgatggcgttgtggaagtttcaggccttcgaactttttactgaccatctcaatccggaaatgtgtctcagcagagacatttccctgtacaccagcatggcccttatgcttgtgagaatcgttgtagaggccaaacgcaaagttcttgtaatctggaaagccgcattccagtctcttcaggatggtacgtgccacgggaccatctgtgctcattgctctcttgaacattattctctttccactttcgtttgctgcta

SEQ ID NO: 14664 - DNA, 400 bp, Saccharomyces cerevisiae
gacgtcgaataaataacttaatctttaattttaacgttaaataaaaaaacacatattttgttccattttttttcattttttttagcatatctaaagcatataatacaaacactgttttctgcaaaaaaaaaaaaataaaaaataaaatataaaaaaacaatataccacactatgctgcacacgtgaaatgatgaacttgtacgtcaccactttgtgcgcaaaaaattggcaaaagtagagaacatgtcactaactgtatcggaatattacaacgtttttttattctacttatctcaatggctaaagtatatatctatctatatatgtatgtgtaggtgtgctgatggagacaaatacgttttcctctagccttacaacaggccggtaccattctttatcg

SEQ ID NO: 14665 - DNA, 408 bp, Saccharomyces cerevisiae
tttactttagaggaagcaacaaacttatcaataatttggtatttattattatataaaatgaactttttatgtacaagatttatgattttttgattctatacacgttacgaaattcctcattttacaatgcttttttcaactttctggaattggtcatgaagcttgttcacgtaatccttatgcagtttttccaaatccctctcagcttttcgaacggcatcatcctttttgaaacttttgaattcctttagaatactgcctctgatagttcctaatgagtcttttagcgatgactgcttatattcttcaaatactctctttaagtctttagctacttttaaccgggattctgtagttggtggtggtaacgaaactttcaattgcaaatcgttatttgggaccctttca

SEQ ID NO: 14666 - DNA, 439 bp, Saccharomyces cerevisiae
acttagaacatacgactaaaaacgaagtatattcgaggttactttaatagtatatctgagacctatataaagaggggtatttgtatttaatcgttgatcttgttaagaaaaagcttataacaaatggggattgtcaaagggtattttttacacaaagctttccgcatagttatatattatctcattttcaataatcctcctgtagggtgtagctttgcactttcttctcattgatctcattttgcttagcaaaccatttttcttcaaagccatttgatctgtggacaccgtcccatcttgacccaggcataatggcaaacctgttctcaggtgctggcttatcataaagcttgcggcccagtaaagatgtttttacagttctttctttgtcatgtgtaaatgttattgcagggtcttctatcgtcagactcgaggcagt

SEQ ID NO: 14667 - DNA, 438 bp, Saccharomyces cerevisiae
gaataatgagaagcgagaagaattttaaatacgtaatcaatttttgtagattatctcaacgtacgtaactaaatgctacccttcgtcatccaagatgctgttgcccatttcatagaaactacttacttggtttatagatgtttcgcgttgcgttacagaataaggcagccttttttttttttagattttcatttttcacatactgatggattagcagacgaaaagggtaaagttaaatacattccagtaaatgaactaagaaggctgagcacaccatcctcttatggaacgttattcctaagcatagaaagttttttacttgtaatcttcaacgcggggtgtgttctttatcttttttttcttttttacacaattagacaagtatattttgagatagtaatcacatctacgcttcgaattcatccatacccacagcag

SEQ ID NO: 14668 - DNA, 464 bp, Saccharomyces cerevisiae
cagagaccgtgatgtcgtcaacaagtatttgaaggaaaatggttactattaagaaaaaatctcttttctagccattttgcctttttatatagtcaagtatctatatgtgacaaatacttcttctaagcttggccttctgataggcttagcttgcagtggttgcaaacatacataaatcaacaaaaaagtacggcttaaaattttggtattcatttatttcaacccgtgcacactggaaataaatctgtacataacagcatattttgtttttgaaaaaatttctgtgttcctccgatgtgggaagaattttaggatcggctaaatttcgtaaagtatcagtaacttggtatctctgtataagcggagtctaatttcgataacaagcaacttcatcgtaacaccttccaacaaagcaaagatagatatcccaaaatggtatgttagtatccaataaatgcagcgca

SEQ ID NO: 14669 - DNA, 467 bp, Saccharomyces cerevisiae
cggaaatatgatgaaaactatgtgtactctaattattatataaagcatctataaaatgaatcatgaggattaggccgtgatcttcgcgctccatatatggagaatacttttaatttcacaggagaaattaagataaataacttgaaaagtccactgagattggtgaaagtgtttcatcctctttttcagtttcccttgaacgatagggtggagtgggacaggcgggagatatgttttcctgtaacggctgcatctctggtatatttccatcccgattatatgttttcatggggctggaagtgaataatgaattcgttcttcttattggagacggggaaagatcaattttcaagggcttaatctcatcgttttctctagctagattagacatggttctcctagatttggtgtatgatggatgaatgtttgaagaatctagtaaatcctccaaaatcctgtacttctca

SEQ ID NO: 14670 - DNA, 482 bp, Saccharomyces cerevisiae
tctcgaggcttttgaagagaaactctcctttcactgtattttctacgtaatatacacggtcctctaaacccactatgtactttcaacaaaggaattagctcaatatagagcaaaaggtttaccaagtatatattatattgtacaaaaaattaaaagcgaatttaatttaaatctggcatctagtgattaaattctttttgattcgatttttttctcccccttttatttatttaaatgaaatcatagtcggatccttcatcttcgtcataatattcatcctcagattcatcaactagttgttcaaaattaactttgtaacgcagcatggcaccaataccaccaaaacctgtgacaaattgggcaccttctgaagatttgtctgtgatgaattccaaggtagcaccgaagtttttgtagttagctgctagccattcaattaaaggttcttcggagacaacgtccatttcttggccggtagcttt

SEQ ID NO: 14671 - DNA, 447 bp, Saccharomyces cerevisiae
ctgtcctctgcttttctttatctattttgcatacgattctgtatttaattattctgttttttttttttttttattttttattttcatgtacacaagaaatctacattagcacgttaatcaattgactagttaccttcttgaccaaaatctctagtgaactgttcttgcttcagcaagtcatcctcattcacggtaggtctcgtcgatttgatagcctttaagaaatcctttatggtgagatctggttcttttaattcatcagcttcaatatccgtccaactcatctcgatggcgccatcatcacctggagagcatggtgttagttttcttgtttcgtcgtcctccgtagagacatctttgaaatgtgtcgcgctttgaatttttcttatcggttgcattagcgcatctttcaccactacagcaatatcactcccggaataaccttca

SEQ ID NO: 14672 - DNA, 479 bp, Saccharomyces cerevisiae
atagagtacacatattagcatgtaccgttaaattcagcttcgttatgtctatatctacatacatacacaggtatctactataagaataaaggaaagaaaaaataaacgattaaacattttatttttttgcatcgctatcatcattacctttctcattgttatcatcattatctttcccatcttcatcgtcattttcttcatcattgattatttcaatgatttctgtggtttcagtcttcacggtaaatggttggggttcttcaatatcctcatcattaaccatgaattggttcaatcttttgaactcttcatttttctcctccctaatggcattatacaaaagaaaatttatccaaacttctgcaaaacagtaaataaaaacagagttattgtgaacgtaaaagtttgactcccaaaggtacgagatacttgtcaaaataaaaaaaattagtaatctaactggcacaacagattggaag

SEQ ID NO: 14673 - DNA, 470 bp, Saccharomyces cerevisiae
taaataattcgctgatttcataactgtataataaattttataacttttcaaatcacggatcatttttcattttactttgtcatttttatttcatttgaaaatgggtagaggtacataactggcgcttttcttgcaagatgacatggcattggatgacacaagtattactcaatacccaacgtaaatagctagaagattttgatcggatttaaattcccaactgcaactcagtagcgtttaggattttacaccttggcttggagaaatccttattgtcagaaattgaagccgttaatatttaaaggctaattctccatgccatcttgcattcactttggtatatatctcttgacctcaatatatctcgataatataaatcgcaatattatacttgttagtctgacagttttacacctgtacatcttcaccatcaccacacccttttttactggaggcaaggatgagtttga

SEQ ID NO: 14674 - DNA, 431 bp, Saccharomyces cerevisiae
aggcggtggcgtatcattctttaaatttccaatattttttcccttttattaactagtctctaatttataaccacggggttttcatttctttttcacttcatattgtatgtaaattggttcttcaaagttccaatactctaatatagtactaaatactatttagccaacttcatggaaaagtaaagaatattatttgaagattcttaagtgattacccattttattgttattattgatgtatgtacatgattgtagtaaaatacttatacgccttatgctcaagtttttttgattgcatcttgaattttaacgaaactgtttttgggcccagccacagagcctttaacccaaataacattattttcatcgtcgactttcaaaactttaacattttggatagtaacatgctcgtttcccatatgaccaggcat

SEQ ID NO: 14675 - DNA, 446 bp, Saccharomyces cerevisiae
ctcactttctttcgcatcgccgaagtgccataaaaaatatttttttaacctttacctaacaagaacggggaatggtatatatggaagtacatagttcgtatatacagaatctttagaacatctgagctcactaacccagtctttctaatgctgagatcgttattgcaaagcggccaccgcagggtggttgcttcttcatgtgctaccatggtgcgttgcagttcctcgtcgacctccgcgttggcgtacaagcagatgcacagacacgcaacaagacctcccttgcccacactagacactccttcctggaatgccaacagtgccgtttcatccatcatttacgaaacaccagcgccttctcgtcaaccaagaaaacagcatgtcttgaactgtttggtgcaaaacgaacccggtgtcttgtccagagtctcgggtacgttagctgc

SEQ ID NO: 14676 - DNA, 449 bp, Saccharomyces cerevisiae
aataaatcactgatgataatgcagtatccttcggaaaattcttagaatatttaatataacaaaatggcatgtaccttttggagttgatggaggtgagaatatagaaagctttttatataaaaatgtacttattgtctttcatttcaattttgaaaaatgtctgaattgttcatgaaattgtcgtttgtggcagccgacatagcgtccatggggaacctgcttggattgaataaagtgttatcaaatgaaccgttttcaatagccggtatgggaaaatcttctgagtttgtttgaacatcataagaggaaattgttccagatttttttctatttttcctcatctctgccgacatattttgattataataagaagatctttttttgaattgaggtcgtgatggaaccttcaatggtgatttctttagccgtaaactagatgcaccgatggc

SEQ ID NO: 14677 - DNA, 411 bp, Saccharomyces cerevisiae
ctctttcgaaaagacagcgagaagggacactggaaaaatggcataaaacttttcaaggttattattagtaagtttttttattatatgatatatatatatataaaaatgaaataaattatttcttgatggagccacttatttttcttataccaccggcggcgcttgtagtccttctccctgacgttactctcctattcttgggcaatagttgtcttagtatggtatcatctgcggcattattgatgttcgttgcgctgggttcgttatcttccattcgggacgatgaagcagaggagatatcatttttcttgcgcgaaactttgggataatgattacttgtgccgttggtatcctgcatggattcgtcatctgagttgttgctttctattactaccttcctattcgcatggg

SEQ ID NO: 14678 - DNA, 421 bp, Saccharomyces cerevisiae
aaaaaaatgaatggtatagaatatataaatatagatgtaataaatgtagtaaatgaacaaataatcttcctacaaagtactatgccatgggaagtaaaaaaaattaataaatattggctaaagtgtttcaaattggttctacgatactgggagactactccttatcataatgctttttgtccagtagtaaaaattgaagtaattcttgaacaatttaaaaaaaaattggaacggcggcacaattatttggtatatggcagctttggcttttgcgccaccacatacaaagttctaaagcagccagcgttgtcatcgatttttcctatgtgttcttccacatatcttttgaaaagagtggtggggtcggtatcctttggaggacaactactatctggtagttgcctccttaacatgtagtccc

SEQ ID NO: 14679 - DNA, 426 bp, Saccharomyces cerevisiae
taaaaagttgttatataagggttttcgtatataacacagaatggtaaaccgagtcacgaagctcaatcttttttttttatgtctttctctaacgttttttcgtctatattcaaaaaaaataaagttggtaacatataatgcatatattcatttgatctaatcgcttgctttttatttcagtagcattttcgtattgcgtcgcgaccagagaagtatgagcaccagaggtaacacgtatatacatttatacataaatatatctatttagtttcctttcttggaagcttcagcagctgctacatttccaggttgattcttctcatcaaaatatttctccaggtttttgacttgcttttgtaggccctccagagaaatttgctttttccttagttcctcttgaagtttggtggaatcagcttcatttga

SEQ ID NO: 14680 - DNA, 496 bp, Saccharomyces cerevisiae
attggtaactgaacgttaatcatgttatttttttaatcgctgtactattaaaaagggatatctttacgacaagtgatatggatgtatagattgatggtgtatatttgtatactataaaatgtccaatatattgtacactattgaatcacaggacacaaagtaaaatggtagcaattctgtcggagaatgaaaataatgtacttattttctcttttcgcgaaatgctttcttaaagtcgtccagtacacggttttcactagcaacgttaaccgagtaggctgctgggtcaacatggttcttgcttacctcccaatcaaatttggaatctgatgacattcttggatcataaaatgctgtaatatcgactgaagaatccactgtatcttctggattatcaactctgttattactattgctgtttgattgtatgacgttatcattaattttaagtattggtagtttcttattgaaatttaatgattggcttttgggaaag

SEQ ID NO: 14681 - DNA, 467 bp, Saccharomyces cerevisiae
aaagtgaatatccaaacgagaatgtcaatggtgatagcaatactatcaaacctattttctttcttcatttttgtgtcccatcactattagtattttgtattatttctaaatttttttctctctaattttcaatcttattcaagtgtttgttggcggtactgtaaattttcattttttaatctctcccttctctatttgttacttattcggtaaatatctcctttatgattttattcaaattccattcttaactaactaactatactgtttataaatttctcttctcttatatatgcaaggtacagtgtgtaaaattaattattgtatttgaagaaaaggctttaaaatctgaacatttgaagccctaatattctgcaccgtgccctattaattttcgcccctttccgtagaagcccggcgagacctcattccgactaattttcctcaatgctttgcccttccttgta

SEQ ID NO: 14682 - DNA, 465 bp, Saccharomyces cerevisiae
tgacttgcaacgaataaatgcatatactctagttgaagttttcttttcttgttctatacaggttcgaatacttgtgagcctatctgtataatttaacagaatcccgaaatattcatctagaagccatctatttagctaagcctacgtatgcggcgatttttatattatctttttttttttttatagaagactgcgaaatgttggcagaatggaaagtttcagtgttaaaaatagaaactgaaaaaggagatctagccaggaatatatcgaaaaaaaaagtgagggaaatcagatcctacacaaatatttagatttaattgaagaccctggtctgccagatatatatatatattagacgaactgtgcattcagtcagcaaatctaggccacagattttcttattgaagctatcaaaatagtagaaataattgaagggcgtgtataacaattctgggagatggctga

SEQ ID NO: 14683 - DNA, 486 bp, Saccharomyces cerevisiae
tgttataattatccccgccaatcacccatctcactcaacttatccaaaagaaagccaattgtgtatataacttacataacctttaaatgatttttttctaattattccagtattactattctacacaatgcataataaatagatataaaaagtggaatgtgccacatatgcatttttttaccaccaataaatatcagttacttaaatggtgccttcaaaggatcaataacttggcctggcttagtcatgattctcggtttgataagctcttgatgagatgctctggatgtccattcttgacctatcggcatacgtaaagatctttcatattgttctctattttcgaatgggaatggtaccgctgaagattggtatttcaagtttttcttattaactttttcatttatgatcacattttgtagattcttatctcttcttttgtctttattaacaacacccttaacctttttgatgaatttacgcttc

SEQ ID NO: 14684 - DNA, 493 bp, Saccharomyces cerevisiae
aaaggggagctgtcccacgacaataacattaataacggttgtatttcttttgttcctgagaggaagagaaaaataaaataaaaataaggtaaatatttataggtatgtatatgctcacgatggcaccatcctacctattatttcttattatataaacagtgtctatctcattatgatattaaatgtatacttttaagggggaaaactttttggtttaggaatatagaaaaaaagagatgatataaatgtttgcatgtccattgtaaatgcattggctagatatcccatttagcaaaatctgggatatcgatatggaagaaaggtagatttgttcctgaagcggtataaacgctatatttttcaggattttcttcgccttgaggtactctggcgacgtgataacttgtatgaccggcaacaatggattcatcactgtattcttcgttcagagtaccaaatcctctgctaattaaacctctcttcacccatggtg

SEQ ID NO: 14685 - DNA, 439 bp, Saccharomyces cerevisiae
taatcgcactcgcatctgtcgagtatataaatgaatatacacagtcataaatacttctagaacaaattacactaattaagatgcttagattcccattcaaaaggtactattgacgtcttgtcttctacaatttctcatcctctttgaacattggtaatgttattctagttattgttacccagtttcggaactttaggggagccacactttaaacaaaaagaagcgccataaccaccgtgaagtaatgagtatctcactttgataagaagacatttaagaacagcctgaaatatcaaaatcacggaattattaggttatggagagagatgaataccagttacccaactctcatgggaagaatactttcttatcgcgaatatttggtttacaatcggatgaagttaatccttctcttaatagccaggagatgagcaacttc

SEQ ID NO: 14686 - DNA, 400 bp, Saccharomyces cerevisiae
tctaatatgtaaatatgtatccgtaaaagacattcttaaaagtttgaatttatgatctttttatttttgtatttagtctttgttttcgaacttttattaatattaaatttcagtaagtaaattaaaagaacatctttaaaagagtatatttattgttacatatgttgatcttaaaaggagatgaatatttcttaatggaaaaaggtaaaaaaaagattttctcattcatatgttcccattaggcagttctatgaggcagtcgtccaactcgtaatcagagatctcattctcatcctctaagtagccctttacctgaaaaaatgttcttttgtttagagcatcttccgtctcttcacgatttaagcgttgtagcttggatttgtcctttgatgtcaaccgt

SEQ ID NO: 14687 - DNA, 456 bp, Saccharomyces cerevisiae
ccctgagatttagtttgatatcgttagcataagctatttgtcacgttactatttctctccttcatttattcttccatgatatataaatttttgtcaagagtacagttattattatattatatcattattataattgttatgattactattaatattattaatgtttattatcaatgtttattattattattgttattacacatgaaaagtgaaatttcattacgcatattgtcttttatagtagatcgctgtcagcatcttcattaacttgtttggtgttattttccaaattcaataatctctttttcaactctaacacttcacttttcaagtcatctctttcttgattagtgatgaagagttccgctttcagatcatttattttgatgttgaattgattttctcttatgctgttgctattttttacattattggaactctcctcggtgcttctga

SEQ ID NO: 14688 - DNA, 483 bp, Saccharomyces cerevisiae
ttgatttatcgtaataatttggacagctttcttgcctttttctttttgtgttcacgaattttaatcttcttagattaactaggaattatgacaggttttttatttttctatttttctgaagggctacataaactggtccgacgcaaaatttgttaagtgtgacactgtaaaaatcggggacttcttcgacaaaaaagtgcaacaaaaataaaataaatacatattaacaaaaccattcgaataaaaatttatttgtactttcctttctccctgattttatttgaaaaatagataattaagcatagctattttcttcctccttgcctattcgtttggtggctttctttataattcgaatcagttcgcaaattttttggtgaagagctattcaattattagctaattatggaaactattttgcagccaaaggctagaccatttgagtctttgaaaagaaaacgttttagagaatggttgaggccg

SEQ ID NO: 14689 - DNA, 463 bp, Saccharomyces cerevisiae
atgtctacatacatacatacatctcgtacataaatacgcatacgtatcttcgtagtaagaaccgtcacagatatgattgagcacggtacaattatgtattagtcaaacattaccagttctcgaacaaaaccaaagctactcctgcaacactcttctatcgcacatgtatggttcttattgtttcccgagttcttttttactgacgcgccagaacgagtaagaaagttctctagcgccatgctgaaatttttttcacttcaacggacagcgattttttttctttttcctccgaaataatgttgcagcggttctcgatgcctcaagaattgcagaagtaaaccagccaatacacatcaaaaaacaactttcattactgtgattctctcagtctgttcatttgtcagatatttaaggctaaaaggaaatgttgtcgagactatctttattgagtaactcgagggcg

SEQ ID NO: 14690 - DNA, 442 bp, Saccharomyces cerevisiae
gaaagtggctctgatcccgatacccacttatagatttatatttacttaatgtccatatgtatatacatatatatatatatatatatatacgcttatatatatatatgcatattctatccaaataaagatacctctaattatcgaattatttttcacttacctttaggtgtacagttagaacaatagcttattaaatttatttttttccctatgttccgcggaatattgaaaaatttgaaaatattctaagacaaaaatacccataaaaaacaaagagttttgagctcatctcgttgccacccaaacttatcacaaaaaaggaagcactccaagaaccgcgtgaagaaaatgtcaaaagaagacatagaaggaactaacattctagacgaacctgtccacgggatctatattcctgccgcgctattcgttgttggtgttgcaa

SEQ ID NO: 14691 - DNA, 485 bp, Saccharomyces cerevisiae
tacataacatttatagcgtaacgatgatgtataaagttacaagcgcagaggagtgggttcaaattcggccgacttgttacccgcgttcgttgaataatggaaaatatgaaaaaaatagaggaagtcgtgaatatacaacggtgttcagcacctgtatttcaatctaggggaagcctgtatgaccaagggctgattaaatattagtgaagatacaagtaacacagtttagttatattttcttttccttttcaacaggattgccaacgctgcagtagagttataccaacatttgctccgctttcaaaacctataaaagaaagcagccctcgaatcgaattaattcaccaaaaatgtctgcaaatagcaaggacagaaatcagtccaatcaggatgcgaagcgacaacagcagaatttcccaaagaagatttcagaaggtgaggccgatttatatctcgaccagtataacttcactaccaccgctgct

SEQ ID NO: 14692 - DNA, 438 bp, Saccharomyces cerevisiae
aatgggagtttctgtctccctaggtttcacctcatttttattgaggtttcttggtcaatacatactcaaaaatataattaataattcacaatgttcataataaaaagatccgttttgtctatataatactattgatttctattctgtgttgtcaaaatttatctaaagtttagttcatttaatggcttcatttcataaaaaggccaaccaaaaacaaaaaaatagcgataccaatataaaccattgaagaactatcattaggttctttgccatctttcttggaattattttctgattgtctcaacgcttgttcagcgcgtattctgtcttcagggtctagaatttcctccaacgagatgactttttccttcgcagcctttgtaaaagggtcttctgtttcatcacctgtatttgccgcatccccctcatccaattttc

SEQ ID NO: 14693 - DNA, 406 bp, Saccharomyces cerevisiae
tggtgctcttaatgttttcccattactactgataataccttgggcactacgattatctgatcacatttaacagagaaatttaaaaaaagaaaaatatctatataaaaatatgtaaatgttgctattattttatgatgttctgatttttttcgtcaaaccttagatttcttatgtacattaaacttaaacattttgcattgttcttccagttcttggattatattatcttggtgggagtcaatcaaatcccaatcgacgctattactggacaagtcaactttattcgcaaaacaagtcctgtaatcatcaccaaaagtctcaatgaatgcttcttcattaagatactttgaccattccataggcggaaacgtgtttttatccaacactctgtcactcttggaccgtg

SEQ ID NO: 14694 - DNA, 483 bp, Saccharomyces cerevisiae
caagtccgttaaaaagatataatatcacgaatttgttactaatttaacatgcgtaaatacttatttcacatatataattcaaagatttataagtaaatgtctttgtgctaataacacgccgtcccgatacgcctcaatggttagcccttatttcattttagccgctcctcttggtctccggaaccttcttccagataaaggcgcttattgagcatgctatgatagcaaaaatgatgaaaacataacctgacaaaacatcatgaataatagggaaagtatatgcaatgataaaagttcctacccaattgcaaatggtaccatatctttgcgcaaggaccatatcctgtggttttgatacttctctcattattataaatggcaacggatttaaccccatcgtgaaaacgcccatatatataaatgaaaacacaatcaaaaggttcattttattatggttcattgctattcccataatgaaggcgg

SEQ ID NO: 14695 - DNA, 452 bp, Saccharomyces cerevisiae
tgataatatacttgaataaaaaccgtatgtaagtaagtagtaagcgcatcaattcattcattttcatttccctcgcttagatttatgtccttgatcacttcaccaagtgtgccggagctgcggccacaagcccccaaaacggtcttgatggttccagcaccttcgatgtatactctggatggtattgagtgcccacgtagtatggatggcctttcaattcgaatatttcgcaacgctggcccgtctcgtccttaccaacaaaaataaagccacgagactccatatcattcactattttcgggtttatctcatagcgatgacgatgtctctcatgcacctcattaacttcaccataaagcttccttatgttgctccattctgagttcggttggaaaatggtaggcctcaaacccaatctcatcgtgccacccatgtgttccttgtcgatctcg

SEQ ID NO: 14696 - DNA, 442 bp, Saccharomyces cerevisiae
gagaagtaattcaccacagaacttttttttcaaatgacagtaaatatgtaaacatatacacagcctttcagtatattaagtatttttgcataacgtccttttttcccgctcggtcaaggctttgaaaagatattatcaatgttctattcttactgagaaaagcgttcctccaaaatgcttttgctgtaacgtacaggcagagacttcaggagtatataatggcaggattgaagacatttgatgcgtttcgtatgttatatggatttttctgaagtagcccgcttcagcatattttatttttgcttttgctttttcactaacaatggaaatttaactttacagcaaaaactgaagaacagtacaagaagaaatccaccaagggtggcttaacatctttgttgacatatctgtttctgttgtttatagcatggaccgagtttgg

SEQ ID NO: 14697 - DNA, 437 bp, Saccharomyces cerevisiae
acatagcacttatgatattttcattccgtctttaatttccacttgtatgtacattgacgctgttatcagatttaagtaaaaacaaaggaaaattatatattgagaaaaaaaaaaattctgttgtactattccataataatttactacaaaacttgctaaggtccaactccctgtcttcacggttgttaaattaaccttattaatgatgttttctgtccatcccttttgtacttaaaattaaatgcgtaaaacttttgtcctttttcgttctctttcaacaacaatagtttcaattttgttagcctgttcaaattgtacaataagatttcattccgtttacttgtcggtaaaacagctaatttttcctgtatgctagttaatgataaggaatcaacttcattatataagtacaatatgctcgtagtacacatgttgga

SEQ ID NO: 14698 - DNA, 445 bp, Saccharomyces cerevisiae
tcatcatgactgttacctgattttagaaaacaaatttaatattcccttcaggatagaaatttcaacatcatttgtcgtttcattagaaatatccaaaatacaatctttgaaatattctgttacttgacatttgggaccaaaaggaataaatttcgagccatacatcgttaaaataaaatatagtagatttttatagtttttacaatcaaaaaattcgttaaactctttgattatattttgctgtatagtttcagtccgaccttgcttttcactaaagcgtctcctgagcaaggcgctttgtaaatgagggaagatttgtagtagcctataatgtaaaaaaaagtcgttcttgtccacaatttcgaaatatgaatttatgaaatgtgcctcattaaataattccaggaccttaaaacacagtctatggtccgattccatagcgtta

SEQ ID NO: 14699 - DNA, 497 bp, Saccharomyces cerevisiae
tgaggggctacataacattatttctaaataacgcaaaaggaaattatacgtctaatgttactttagtacattgttgtcatactagtatattttgcttagatgataaaataaataataaaaagagatacgaaaggctatgcggtagtcgattatatggccttgtagtataataatgatgcacgcaaagtattaaataactcagctgagatttctcatttctttaaatgcagtctcagtttaaaaaattaactatattaagatccgctctttctaccatatgatgcaaatgtgtcctcgaactagtacttgcaatttcaggtaaccccaatcgtttctttattattgtcatttttactatcataataatatcatccgtaataacaattaagtaacaaatcacatccatgtaaccatttaatttgtttcaagtaacattccgagtgaatagctagtcacatacatatatcttacctgccgctccgctgcaaatgacttta

SEQ ID NO: 14700 - DNA, 482 bp, Saccharomyces cerevisiae
tcctctggcgtttcttatcaatcctttctcttctctatgtatatttttagaaggataatacctctatgtagacaatcttataaagatcttcgcaacaatacatatttcacttactaatatatgttgcgttttcatgcatcaaaagtagttagcaatgctagatcgtgtaaaggaaaaaaaagagaaatagtataattcgccatcctcataaccactgaaaaatcgaagttaaccaaaaggaaagttgaaatggaggaagtgttccgtttttactcgaactctagaaatatcttcattcataaaagcctttcattaaaaccatccaccattgatgaccccaaaagtggatatggccttttcgtagaaccttcgaagttcaagaatgatgaattgaaaagtgaaactatccaattgctccgaatccctaagcgctgcacgtttaatataaacacacttctggctctcttgggagatgaggacga

SEQ ID NO: 14701 - DNA, 426 bp, Saccharomyces cerevisiae
taaatcgttattttgtctgacttttcttaactacccatttcattttattacggcttggtgccataatgatatactaaataaatatgaattttgccttttcttaattttccttatacgtatagtcattacaattaataaagtaacattataaagtttctgcactagcttttggcttgttgatattttctcttcagagatgaagtatggtactttttcaatatataatatgtacatggttgagagaaatggttggtaatcttgaaataaaaggctgaaataaagtaaaaacgtaaaggaggctagtgcgatacgtcatttatgtaacaaaaaacatgccgaataagggtacttccaacaacgatgaaaaaatggctcatataatgtctacatgcctaagcttgcagaggttgagaggaaggtgcttcg

SEQ ID NO: 14702 - DNA, 400 bp, Saccharomyces cerevisiae
tacagatttgcaaaagttaaataaacataggatagattaaataagaaatcatatgaaaaaagaataaagtaagaaaatagttcaatgtatattcgtcagttcagggtgtgaaaaggtggcaatttttttgtttccgacccgtaacaagtgttcaatggtggtgaagtcttttcttggcaaatttctatacttcccaaattcttcatgaatataattcacaaaattaacttggttttcctttggttttgtatgagccgttcgtatggaagccctatacaggtgtaagacttctttttgtaacccacttaatctcttaggcatgctcttggtattgcgtctcctcttcttcttgtgtgtttaagctacattatctttgttaagaataatttggcgaacccct

SEQ ID NO: 14703 - DNA, 498 bp, Saccharomyces cerevisiae
ctcaggaaaagttggcgatagaccacgagcgactgaaaaaataacagcgacttttctcccggtagcgggccgtcgtttagtcattctatccctcggattatagactgtgaatattgcatatgcaactttgactcaaatttttccaaaatttgatatatatatatatatatatatgtttgtatgtatatatatatatacgtatatatatcatatatacgaaaagtagaaaaaaaaaggtgatatttcgctcgtggaaaagctaatgccacagcttgtgtttcgtgtagtttgccttgctccccttgattgaaatagtctccctaaactaaagttatcagcaaacagaaccaccacagttactactacaaccacatcgcaatatgaagatcacagaaaaattagagcaacatagacagacctctggcaagcccacttactcattcgagtacttcgtcccgaagactacacaaggtgtacagaacctgtatgaccggatgg

SEQ ID NO: 14704 - DNA, 445 bp, Saccharomyces cerevisiae
gaataagcaggagtccataatgtttatataattcttaaatgtagttagttcatatacatgaatgtgcacttttcttgaaaagaaatagatttaaaaccacaccttgtatatatattatgcttttttccactactttattttaacagtcactgttctggcatacgtttcgggtaatgaccgagaatggaatatgtattgaacatattgaaattaaacatgttcataatatcttctaacaccattggaattgtgagaagtagatccgtaccatcaatagccggctcaagatgtcaactgaatactctgctgattcatctaaatcatttatgattgcaatgcaatctatgattgatacttcacaaacctttaatctagatagatcgaaaatctctttaccagattttgatgacgagctaaaaaaagtccaaaaggatgaaccaaatca

SEQ ID NO: 14705 - DNA, 493 bp, Saccharomyces cerevisiae
tttaacaaagatagtttgaaaatagtgtctacataaaaaaacaaacatttttgagctggaaaattatattttgtcatgaagtaatctattcttaacgcgcttttcgcatacgctctttgatgatattttagatgacccaaaagagttaaaggaaatcatcaatgatcctccagtaatcttatactctagacagttgtccgtgaagttacacctaaataatcatatatatatatataacttatatacagtggtctaatatctattgaataatattagaacatgctatgcaatctttttgcttgtgtttgtgaaaccaatacccttgatagtagctatcatgtcttcattatccgcctcgtcaactggttttaaaaagacttcagtattaaagatcttcttaatatctctcaagaggattatgaatctttcgtctatctgttccttattaattctcaatctgccgatatcttctttcccgatgaccatgtaaaca

SEQ ID NO: 14706 - DNA, 500 bp, Saccharomyces cerevisiae
agggcttaatgagtattttatctgcaattacggatacggttggtcttatgtagatacatataaatatatatctttttctttctttttcttagtcaggattgtcgtttagcataatatacatgtagtttatttaatcacataccactgattatctttagaattttataaatttttgaaataaatgggtggcttttaatggtgtctatgttaagtgaggcttttagaatgctcttcctgctttgtttattatatgtgtatgaaagatatgtatgtatttacatgtgtttgtagcgtccccagtcaaaacctgtgcgctatacctaaatggattgataatcttcattcactaattctaaaatagacttcttccccaaagaacggtgtaacgatgaggctctatccagctgcttatctaaatcaactttaacgatggatgatcttatgacacggggatctttctttaaagttcttagaatttcagactgtaccgcagctgatga

SEQ ID NO: 14707 - DNA, 464 bp, Saccharomyces cerevisiae
aattttacaaatagccttgcgtctaagttagcagaggacattctgtattcctgaggagtttctttatatttattatgtgatcttggaggattatcattttcttttcgttcaatattttatccccttcagttatttccagttatctacatcaaaatgtttgaattttatttctttctgccgctctcaaattcactctcatttcttttttctttgtttttcttatatttactatatatatatatatatatatatatatatagccaaaaacaataacagacacagtaatttagtatgcgtttatctcttatctttcatccactgcgaccgaaacgtttgaatcgaatctgactgaggtttttcttacattcccttgtgtatcaacagtttctggtatgtctaattcaaattcttttccattcttcagtatttcttttaaatctggctgggcctctctcatggaagat

SEQ ID NO: 14708 - DNA, 491 bp, Saccharomyces cerevisiae
tgaaaacaatcaggagaatacctaaatatatgacgtactcgccatacctaactatgtaaaacctaattatgtattaataacaataccatgttgtatgtaaactctgatgtaggatcgcacttttgccgaaagcacatgcttgtctttgtatttcgcttgtacgcctttgctcagaaaattctgtaggagtcacgtttcccgttgaaatccaaaaacctgaaatttttcagtctgaaagaaaaaattgcgatgagcatagatgataaatttaaccatacaacaaagagaaatccttttccccacagaacattacctaaacccaacaactttctataatttgagatagaatgtcagaaacagaactgtcgaaagaagatgctgttacaaaaaaggataacgaggaacaagtcaagaaggctttactcgatccaacaaaaaagagaaaagctgaagatgaaattgagattgacctgaaaagctccattccccta

SEQ ID NO: 14709 - DNA, 405 bp, Saccharomyces cerevisiae
ctacgtaaacttgcctgtacataaacacatttatatgattttccgtataatctctttttatcggtcctggtagaaggcaatgcccacaccaagcagactgccccagaaattacaaataatatccttcacatcgaacaccctttgtccccgcgaaaccacgctttgggcgaattcactcgttacacttgcgcataatgaacagatcagcacccctaacacgtacttgttggcctgtagcttgcggaaagtcacgatgtcctcagcaaacatctttacaaacagccacgactcccacatgaacacgacaaagtgagcaactttgtcgttagtcgacgtgatcgcttgaaacactttgttggtagtgatgcctaagatacgtgcataccaacgagcttaccacgaaca

SEQ ID NO: 14710 - DNA, 458 bp, Saccharomyces cerevisiae
agcaaagaaagagcacacataatattctaaccagtaaaacaatcggtttgaattttgaagatgaagaagtatatttatatataatttcttcccttttttttttattttttttttgaaacaatgcattaaaccattacttatattatttatatgtataaatagatattaaatcatggatttaaacttgaaaaggattaggaaaaaaagagtatggtcgccgtaaaaaagaggaaagggtttatttttgcgcccttccctctataacttccaagatatgatataacgagattgcacaaatttactcaaccttagtcgaataaaccgaaacccatgtcgtcgtcagattcttcagcggcttcttcttccttttcttcttcagcagcagcatcaccagaggcagcagcagcaccgccagcagaagctggaccagcagctggaacagcagccaacttttcgtt

SEQ ID NO: 14711 - DNA, 492 bp, Saccharomyces cerevisiae
aaaatgtgattgttaataaggggtgggatgcgcgaaattctatgcctacagtagaaagcggttgttgcacaaatgattaaatctttatctccaactcacaatactatcgcgatagatgcataatatgtgcagcttctaaacagcacggagtgatgataaatacgcatatatgtatatatatatgtatgtgcatatgcacgtccttttaaaactcaaaatacaacattcttagtaaatccttttgttgacacacgtcggaacaactcaggacggagttaatggatatgcttcataataaatgtagtgatgctatcaaaagcacctccaatagcaatttgagtaatgaggtagacaaacaaaaattgcaatacgatgacctcgggaacaccggattttctgaactatttgagatggaatctcaagataataatgatagcatagaggatttcttgttctttaatataaatttaacccaggaggttgagttcgaga

SEQ ID NO: 14712 - DNA, 465 bp, Saccharomyces cerevisiae
atgctcttatgattgtcacttattaatgataaattataaaatgttatatgtaaaaaaacaaatatacactttttgaatattagtatcctattttaatatactgtctcctagataatacaaacttaatttgctttctcttcacacttttttctttactcttgtaatgtacacttggctgtacattaaaaaaaggaatgttcgagcaagagcatgaaatccacagacggctgtgccatgtagcagccgtcgagaaaaaaaagatatagaaaagggaagagaaatatcattgttattacatccactggatgaagtaatactacgagctttatacaggtaatattaaagttccttaatagaatgggtgaagcactacgtagatcaaccaggattgcaatatccaaaagaatgttggaagaggaagagtccaaactggcccctatttcgacaccggaagtgcctaagaag

SEQ ID NO: 14713 - DNA, 483 bp, Saccharomyces cerevisiae
atcaaacatcgttatttcattcttacatacctgtaaatatctagtacgtataaaatttgaattgtatgcctgaacagaaaaagaataggtgggctcttcttatccttgactatcaaaattccggcttagttcgtcagaaatggatatttgatttttcaacaaacatttccgcaaattagattcctccttcttttcttgatacttaataagtacctttaaaagcaattcggatattgtttgtacgggaaatacggaaggtatagtttcgaggatctttaattgaatatctgtatcatctaaaagttcaaaatttctctgtagcaaattagtcactaattcaactgagtaattcaaagaagatatgtccaagtattgtttcatcaccgcaaccaagttctgcttgcctatgtatttttctacacttctgaaatcattaaatgacaaatatattttcagcaattcttcggaagaaacccagtttgt

SEQ ID NO: 14714 - DNA, 451 bp, Saccharomyces cerevisiae
gttgcatagctgctagtaattatatggctatataggatatcacaaataccatacgtactacagttttatcatccggctgttcgtgtaaaatgatgttgttgtatcggatagagaaatacggatagaaaaggtaaaagtcttcaaataacaaggacaataacatactctgtattgaagacgaagtactcagcaaagcgtaacgtaattacacttagcacacaaatatactcacacaaatattacaaggcatgtcgacggataccatgtatttcaacagctccaggctgttgccatcggctggcaggaacaagacaaataatctaatcaaacaaaaaactagaaataatcgtgcgaggggaaatgctgctaagaacgccaataataacaactatatcacagatataccacctcctcaaactcttcctaacggtcagaaacctaacttcggcca

SEQ ID NO: 14715 - DNA, 474 bp, Saccharomyces cerevisiae
atcttctctccggctccttctgatcctacgcccacctatatctacatatatctacggcactaaaaacttttatgtaccgcataaaaggtgctctttagcaactatttttagttaattatttgcgttttagctttcaggaatttgcttgctaagacgatgtctaataaatccggtacttctttacttgcaattaattactaagcggcgcctgaatttttccggcttgatgccgagcaaaaattaactctaaatccctttctgggaacgagtctttgaagttctacggtcttttgtctcaggaaaatatgtcccgagaaagatggaataagtatggattttgtccttaaccagtggaggtggcgctgcagtccttcttttcagacccaagcaaacagaccaaaggacatttttttggaaaatgttaagaatcaaccctccgaaatcttttcacggctcaaattactgcggcctttt

SEQ ID NO: 14716 - DNA, 421 bp, Saccharomyces cerevisiae
tgaacaaaaattacatctccattatagagcagtcgcagatagacaattttcttttatttttttttttttaggtagataaaataacatgtatcgcaagacttttatatcagcagccttttcaagctccataatttctgaaagaaaaagtagtatatgatttttgaggagaataaatttcaaaaaatcataggaaaataataacgatgttcctcccgttaatttacaggtctataagtatttttccaatcaccattttatccactccaattttgcttttaaaataaaaaatgcaataaggcgataaattatggctacgcacacaatgattcccaggtacttttgcgtatttctgactaaaccataagaaaccaacacatcatggccattcgcaaattcacaagtaccgtctgaatttttcccg

SEQ ID NO: 14717 - DNA, 466 bp, Saccharomyces cerevisiae
gtgaggctgaagctttttacgtttgttacgtttcttcacttgcttgtagataaaacctttataatgatatatgatctagattaaactcaacgtttgtacgtttaaacctaaaagtttttggacctgtcccaaaataaatattatcacaagtggtagtactaaattgagcgtaacaggcggactctgtaggctttttgtgagtttggggtctgaatattttttactcttaaaaaagaatacagaacttactaaaaaaaatccgtactaaaaaggtagaaacaagaaatggtttatttgaaaaaaatactttacgtcccagcctcactaaaattgagcaggaaaccgtatatcaaaactatctaccaagagagttctggtaaaaacatttatatgaataaagattaaattatgcctatttttttcctagcagtacattcactatgtttctatatttaacgctttgtcg

SEQ ID NO: 14718 - DNA, 488 bp, Saccharomyces cerevisiae
gcaagtgcttgagcttcaataaaattgttttgtataaattagttctgccgtcagaaaagaaaattaaacatatgtgtatgttcttctcagcgttttattgtgtactaagtaaagttgtttatatgtccattatttttaatctaaaaaaagcatttgatattttttccttcgagttatccattatactaggcagttctcctcagggagccatgcttcagctgaaactttaggaaaggcgcgctacgcaggaagcgctcttattaaagggtttttcaaataaactaaaaatgaataacaacgatcgaaaatcaataaaaactgcaggaggcagcatgtcactttcaaataagactgtaaaggaattacgacaactactaaaggaaaggtacaccgtggaagatgaactaactgaatctatagcgctatcaagtatgcgattcaagccgtcgcaagaacctgaatttcatgcgctaagccaatcttccttg

SEQ ID NO: 14719 - DNA, 461 bp, Saccharomyces cerevisiae
tttaatacaactttggttacataaaagtaaaatttatacacctcatttcattatgtagattcatatatagaataccaattatgattgacccaatagccatcaaaatcagtagttattaatacttgtctttctaggagccatttgcatatttctgatatttcatgaagcgaaagtacttcacgacacctagattgcaatctactcaatgttatccctggatgaaatattatttcgttaacgaccatagtaactacctgcttccatatgtttggcctaatggaaccagatccattcacccataaacgagaaaatggtttgcccagtggaactttgacagcagacttccttgctgtattcaattttgtctgagaattggcatatataatcagagggggagttaatgttcgtatttcaaatctccttgaagtatacgttaaaggtcgaacatttctcaccattgg

SEQ ID NO: 14720 - DNA, 477 bp, Saccharomyces cerevisiae
gatcaattcgatatgtaacatttttcttttcttttcttttcctttttttacaatagctaatttacgtttccctacggtattggtcggaacgaccaagcttcaatttataaatatcttaattttaacagcagttaccacttgaatgagaaactttttgatgcctactcttttgctttttcatatcatgacctccctacatgcttcggaatttccttattcgtagctgtctaacagcaccacttagcacaagtacgtccacccgtttcatacttaaagatctcagcagccacccaatctacatttagggtacctgtcacatatcttctcaaattttaggttagctttcaattgtaaagtctctttttggatattgcacgtttcaagtcaaaacgcggctgtaacataattttctgaaacaatattaaaacatagtaatgacttaaaacaagcgactatcgcaaataagcagttcccagc

SEQ ID NO: 14721 - DNA, 452 bp, Saccharomyces cerevisiae
gcatatacaacattcgttaatggtcgtccacgtgtgtatactacatatatattatatatatatatatatatacatatatatatatattacacctaatacgatgaaaaaatacatctaatgaaaagaattgtttttatccttagctttccaaaaagcttggtatatataacaagatttaggctagagaaatgatgtaattatatagggctatatacagagtaaaagaaacaaaaacggagaaaaaaagcaagcaaaatgttactctcagtcatcgatatcgttagcttcagcaaccgcatcagattcggccttgcttccaacaactcctttaacgaaagaagccacattagcaggaggcaagatggcaatcattaatataatatattcgtaaatggcttcaggaatggatctttggtaaattcccaataaatcggctggctgagggtatacag

SEQ ID NO: 14722 - DNA, 468 bp, Saccharomyces cerevisiae
ggctctgaatgagtcaaaagtttaaaaaaaaaaaataattacaataaaaaaattttttctcatatacacgcaccaacccccttcatatatgtatagaatatagtatatattataatactgctatctatacatttgataatcgataattattcgaaagaaggtatatcatacggggttctgaacgtgctggccaactgctgcctattttaggtgtacttttttacttcttatcaccaacaatcacgcaaacataaaatttttatttatacatatatatttgatgcaatttctgccttaaagtacaaaatgcttattccgtagtatccatggcatcagggtctgctgatttagcaatggatatttgaacgttgccctgatcatcaatatattgtgactcgttctcttgaacatacttaacagatctagcgctgtccaaaaatagcaaataagcccttttgacatcttcca

SEQ ID NO: 14723 - DNA, 490 bp, Saccharomyces cerevisiae
tgcagaaggcaacatctccgaaaataaaaacgatgaagtaaatgaaaactcgtttgtgaatacgtaaaattataacgcgccccatacatagtaagacagacttacttttatactattattttagttatatttttgaagtacaatcaagacctgcaagattataatgttggtgattcaacaatcgacgagaccaactgtttgtaaatgaacgggattgcactggcccccgatagactgatcgtaaaggttatagaaagtgcccgacagacattggtaaaacacgtcattatcaccaatagctaaagtgccatgcttcgttatcgaccagccgccagcgtaaatagcgcccgcctgtggaggtggaccatcaaattggaactgtctgtttgctactatcgatccaattctaccactggagtcaataagaacacctccttgtaacgttattgccaaggtgccagaacttttacaggcttgcaccttgatcact

SEQ ID NO: 14724 - DNA, 484 bp, Saccharomyces cerevisiae
atggaataaataagtcatatgtaaggctatttttatgtaaggggtgtttcttattttttctttatcatcaaataacattactgtaaattataggtgtgcttttaaactcattactatacatcttattttttttagttttactgcctttttgctctttggacaaagaaatcattaaaaagttccaacttttattatgtttcatatataagatatacaaaatataaaatgcaaaacgaatttcagagatagcatgacttatgaaattggggacagactcaagattggtggatatttttgcaccatcaaattcataggtgttattaagccgtggccttcggtaaaagcttatggggtggaatgggacgatcacagccggggaaaacattctggaacaatagatgacatacactattttgacgttcaaattcctaattcaggatcatttttgaaggagtctaagattaaatctccaggtgtacgcaga

SEQ ID NO: 14725 - DNA, 431 bp, Saccharomyces cerevisiae
atgttctcctgattacttgcattatatatatgcttatatgtttaaatactaaacagttgcgctgcctcagtagttaagtaaaaagtacgtagaaaactctgttaaaaaaattattttttcaggcataataagcggatattttccgatgtccatttatgcagtgggaagattaagaagctaatgataccgtaactccaccagtgaaactaaaacgtgcgtccaaaaagcgctgacataaattacttattgatgtcctcacaagaatatacaacttttatagatataccagtgacaagagcgcaggttgaacactgttcttactcgttttggtcctcactgtatcccaaatatgtgccaaaatccatagtgttaaaatccttaccgaaaaaatttattcaatatttggaacaagacggtatcaagctacccca

SEQ ID NO: 14726 - DNA, 408 bp, Saccharomyces cerevisiae
acaagctctttgaaaccaatttttttcaatatagattttggcttttacttacttatataatccattaatatctacgatgtgtacgtttttaaaatagttagattacattagtttttctttgaaaagttcccatttaaagctattttgaagttgaagtaacacgaacataagaaatggagaagacgacgaaacagcgagaagaaaaaaaagaaaacaagatgtacagaaaaccaaggattttaggcaaaaaaagagtcttcgttataaggcggtgaaaagcataactatgtccaatgctgctttgcaagtttatggcggcgacgaagtttccgcagtagtcattgatcctggctcatacacaacaaatattggctattcgggttctgacttccctcaatcaattctgcc

SEQ ID NO: 14727 - DNA, 426 bp, Saccharomyces cerevisiae
tattatttttaaagacatttttttttcgagagagaaaagaggagttctaagtaacgatattttacaactgagataagtacaagtatgcttatttactctattctacttttttgaataggcatagttcacacttttatctccttagtttgtactactctttttttattttttttttttcttccactcagctattagattatttattattttattatctgtggtatcattttctacagccataccttgattttagtttattttgttggcagttatatacatttatcttatagaatacatatgcacgtattaaacaataaaaagaacataagcaaaaatgaaacctcgctacaataaaactttattacgcattgcagtgcgccgtaaagagtattcattagaagtacaatggtagccctatttggttgc

SEQ ID NO: 14728 - DNA, 436 bp, Saccharomyces cerevisiae
aaagatgattagaaatgagaacgtaaatatatgtgtagatttctttttttcttatttatgatatcggtatatgtaattatttatttactttttctgcctccttgatattaaagtattacacactttgacttctttttcttcttgtcgtttctcgtctttggtttagcttgcttgttgtgatgattatttgaggcaattttactacctttgctttttgattgctcgtgaattttgtctttttgtcccttttttgtgggtttgatattgagagcttccttctcctgctgtaagcttcctttcggaagagtactatctgtactattattatggtgtggttgctgtttttgttctcgaatatttttatctccattggtgttggttgttgcagtcgttaattcatcagttagagtatgatttgctgatttttggttagggg

SEQ ID NO: 14729 - DNA, 441 bp, Saccharomyces cerevisiae
aaacggcgatatatattgggcataaaacctatataaaataacagcaataataaaaatgcaaaatataacatagcacggtatagttagctcatatatgttttaacgagccttacattatatcatttaatacgatctcatgtttttcggatttcggatctcgccaagaaaacttgctgatatagaatggaatggaatgacttcaaaaactgcccactcataaagtttgcttctttaaattgaatatatattcacagtccgatttgaaaagcttaccatctgccacacgcattctactccctaatttccacacacagtgtttttgtttctataaagaaaaagaaaaccaaaatactgtactttttcccataattttctttccatacgcctatatgcccatactttgcccggtttatcgaacaacgctgtgaattttgcgagtca

SEQ ID NO: 14730 - DNA, 428 bp, Saccharomyces cerevisiae
ccttgaacaggttggatatttttatattaatatgtacgtaatatgtctggaatatttcgaaaacacgggtaagcaaataaaggcctcccattcttccttctatagaagcgtgagcgcttcctcattaacctcttctttagcagtccatatgtaaagatatccaagagattgttcccataaaacgttgacgctaagcaccttcatcagtgtcatatagaaagacagcgctccaagcaccatttccgttttctttcattttggaatggttaaataatgactatctatgatagtttaaaaataccaatatcatagaagatgaaagtcaaatatatgactaaaaatttaggtgaaaaatgtaatttaatgtatacctttcatttacaaaatgtcaaagactttacacagtctccgcgtcaaattatcacatg

SEQ ID NO: 14731 - DNA, 469 bp, Saccharomyces cerevisiae
tttaatgtccctaaccactcattcttacttctttttgatgtttcttttttttatggtactcataaaagtatttacgtatatagttgtatagaggaaacaaaaaaaaaaagataaaactcaattacaaagtaaagtggacgtatttcgatcatgatttttttctgttttaaccgcattggattttcttgtaaaactggaagaaaaaggaaactaaaaagtcaagaaagacctttttaagactccaagaaccgtcacttatggcgtattgtttgtttatcagcacttctatcttcgataaaggtttgtctgtcttatattgtttacatttcaagtctaattctgtgcttttaccgaagaggaattttcataaatacggagaaaatataaaaaaaaagtaaatacagaaaatagaacagttgaagcagaaaaagagaacttgctaaatagctgtctcacccagacaagcgta

SEQ ID NO: 14732 - DNA, 497 bp, Saccharomyces cerevisiae
tgagtaaatcgccctgaaagtttatatagtgcgtataacaagtacaaatgtcttgtacaaatgtaatttatactaaatgcaatagaatataacatcaatcacagtttttcagtcaccataatggcgtcttagaggccgaactaacttttcttcgtgaaaaattttttgcgatgagatgggaaggaaaaaaagtaatattgacatcttcaattgagagatattacctgcaaaaaggtacatacgatagtagaagttatcgaacaggcaagccaccatggatatttttagagtattaactagaggagcttccgtgaagaaagagtcaggcccaaaggctaaggcagcagattacagcgttataaatggaaatgatgagaatcataaggaagataataatgaaagccagatcgtgaaagaacttgatttctttcgaaacaagagaatcattagcaaggtagaggatgatagagagaagacaaccgaaaacgattctccaa

SEQ ID NO: 14733 - DNA, 426 bp, Saccharomyces cerevisiae
tctacctcgtttggtatatttatcgaagttatcacattcctatatattgtatcctttacataagaattgcgtatagatagatactataacaatttacatgatattatttgattaaggtgcatattaccatcttctcagcaggtattcaaacatatctgccaatgtatgaccttgacatatgtgaagagattactgtggagaagaatagatgtagcattgtgcgcacttattaaatctactacttaaaaaaatgtgtgaagtataaagtgaatctaagaatatttgtagtatttaaaacatcaatgtctgtacaagaagagatatataacctgagcatcctttttcagatagtgcacttcatcgttatcaaactgaactcataaggcgccatttttttaattttttgcctttccgtattgtttttct

SEQ ID NO: 14734 - DNA, 473 bp, Saccharomyces cerevisiae
atctctttatgggtttcgcttttgtattttctttgctttaaaatctgatataattacatattattacaatataaaactttacgataattcctgcaactaatgatgcgttagtacggttcgggcgctctaggacgcgtgtcggtcgggtaaccatcattcttattcgacgaaaatgattagtttccagagaagcagttgcactccagtttgatctgcagtccagcgactatttttaacattcaaagatcatttttcgtttgaatagttgagcaaggtcatataaatttctatatcacacgaataagggttcagatattgctttattatcggcgaacactgatattaccacatagatatcgctctttttttgaaacgtaagcgtaaatttcagtataggtacacgtctgcgctgatccttctgtaatcctctgcagttttcgcaatgtataatagcagcaccaatcatcatgagg

SEQ ID NO: 14735 - DNA, 453 bp, Saccharomyces cerevisiae
agtggctacttgagacaagttttgcgtggtacgtggaaactatataaaaagatccaatcatgaagctattcaagagggtgccatagctatatataactgatcgaaattagggctacaaaatttaggggttcttcgcggcgccattctgtcaagtaaaaaaatagctcaagcagtattctataaaagaatatatatactatatatgttaattgtttgacggtgaaagattaaacatcaatatcatgattcgtattccttcctttttattcgtgatgttgagtaaggtacaaaaccataccaaaccactgaagacaatatccttacaggtagttacatttgcatcgatattgccgcggtagagattactactgaaattctttgctgcttgccgactagaaatttaagaagatttcaaatatgttggagctcacaaggggtcactaaagttggtgc

SEQ ID NO: 14736 - DNA, 456 bp, Saccharomyces cerevisiae
ttgtaagggaaaatatgcatgtaccttttttttttttttttataaggttcaaatccaaagatagtaactttaaatagtcaagtatatagacagaatttcaagaacagtaagtatattaaacttttacagcctttcgggctgttccgtaagctcttactactacccttgggaaacgcacgcgcgaaggaggaaagtttgcctcaatgaacgtgtgtaatggcggtcgtaaaaggaatatagaaatagctgtgcttttataacttcactcgacaatgggttgacagcagatttagaaggaaaagagcatacaaaaaatgtgcgattctcctgcaacgactggaaagcctactattcttttcatcgcagatccgtgcgaaacatcagccacacttaattccaaggcattcaaagagaagttcaggatcttgcgctatcagctggacaccaaagaagcat

SEQ ID NO: 14737 - DNA, 459 bp, Saccharomyces cerevisiae
attggtgtctgatcactgtgtatagtagatctgcagctcagtcacatgagacattaacgtatataaatatataaatatatatatatccattaaataacgaagtaggacatggtctaaaaatagtgcttctcatgtattgattttgagtagccataagaataattattgatttcaagatctttgatctccttacatccaaaattataataccactttatggtatcacgacatcaccacaacagagaaggattgccgcatttggatatcgtaaacaaaggcgttaccatagaaatgtactgattggcagaattactcttcaggagaatctttcatacaaaggaattccattggggaaaatctcgttaccaagtcaatgctgaactttctatggcctttgtttactatcgttaattattttacgaccacttctgggtagaaatatttcgtagccctggaacg

SEQ ID NO: 14738 - DNA, 429 bp, Saccharomyces cerevisiae
gcaaactaacttcaaaacgttaaatcatttttacggattgtttagttttctatatataaatatgtgtatctttttccaataaaaaatataatcaataattttaagagatccgtggattcatttcgtaatagaaaatctcggaaaaatggtacagaatattgttggctaagtgcttcagattgcatcatcagaaaagtaaaaatacccccgtaatccatcttctctacatttaatctcatagtgctcgtaatgtctcgaaatttgtctttcgtgatcattgcacagtcttttcatttgtcacagtcacgtgattacatttaagtacagtatatccaaaaaattagctggactgggagccttctcaataagttggcggtttatatactcaaacctattaataggaaagaactcacaaaagaagccttttgg

SEQ ID NO: 14739 - DNA, 451 bp, Saccharomyces cerevisiae
tgatttttatttacagcctcaactaatttgatcttaatatgcttaccgtttatatggtactcttacatatacataatatatagatatacctgtacttacactacatgcattcaaaatattggtaattgtagtttagttatcaactcataattcatcttcaccatcaatagcatgtaatttttgagcctctttcaactctaatttttctttagcaacttctctctcggttccattctttttactcttttgattcttttccttcatcacgttgtagaaaccaaagaacatgactgccgatattgggcctaataaaggtaaatacacagctatcatgtgctcttgtgggaagaaattttgttgaaccatttctccattgaaaaatgccttttcgcatagtttaaccaattcattacttagatgcagggcattgttccagacgatatctccaccc

SEQ ID NO: 14740 - DNA, 432 bp, Saccharomyces cerevisiae
gacactttcgccgacttctacatacaattacataatacatacgctgttccaaaagctgcacatatactctaatgatgtttttttgagtttcctttcgactcaatttttctaggagggacccctcaaaatgtttacaatgctattcggttttgacaagaaaaaatcaattcaaaactcttacggcgttacaaccgcgatagaatcccttcatggacagaggaaggtgcgccaatatgctaaaatcactccagcgaacactagctaaatgtcagaaatctccatcaaccaaccattggcaatgtttcaaaagaaattttactagtatacgagccactaaataccctgggcgttctaattcgacgttccactattggccctggtttgcggcgtcaacattgctcgctacttcgttatactaccgtgatcgtccgg

SEQ ID NO: 14741 - DNA, 444 bp, Saccharomyces cerevisiae
aatgtttaatcgtttattttttctttcctttattcttatagtagatacctgtgtatgtatgtagatatagacataacgaagctgaatttaacggtacatgctaatatgtgtactctatagattagtttttcttcttttcactaacatagtctagagcggtcaatctttcagctagagttggatgggaataatgatagctagaatacagaggatctacattcatggtggaaaggtttttgatttgtagatcaattagagccctacatagattttgcttgtagcccaattttttagcataagcatcagcttgatattcatgagttctggaaattaaactcatcacgaattgcatggcacattcgagtggagttaataagtcgttaaataacataaatccaatgataatggggaattccttagtgataacgggatcaacaaaactgc

SEQ ID NO: 14742 - DNA, 414 bp, Saccharomyces cerevisiae
cggcaatagaggaactaatcaataatttgactactcttttagcattgtccacaggcctttttcagaaataacgcagacgtctgagcaggagaagtaaaacgcgaaggggaaataatgctttttagtcttgtaattatattaattaattaaataagtttttctttatcggaattttatttaagactttcatttctctaatgctattgtcagttacaggttagaaatatatttccaactatacaccaatgtggaataacagctgcttttgtttgcctttctttttatttcctccactagttgtgttcaattccctcaaattatcgtgcacgttagtatcttgtgtgcttgactttttaccccactgcttaggatcagcaatttggggtctgttcagacctggaatttgcacctttg

SEQ ID NO: 14743 - DNA, 471 bp, Saccharomyces cerevisiae
aaacatcaattgctatgttgtaaatggaaaaaaaaggaaaataggtagatctctcactttaagatgcgatacatatgcctatgtatgtgtgtatatatgtaaggaaggtgttcacgttcctgatttattctttatgtatgtacgccgtttctattcggattggttttcgggattttctatgtttaaaaattttaacagttcttcctttggtttggattcgataatcttctttaaatataacagatgctttatttcatcgctggaaaagtcattgaattgtatagaatctagttcgttcggcacgactacgttagtcagttctttcaaatcccataattttcttaagttattgcttttggaagccgatttattgttactactcttgtcgttgttgctaacttggaaatatattaaagaggctatgtctttgaccatattatcctcgctattgccattttgggatccatttga

SEQ ID NO: 14744 - DNA, 454 bp, Saccharomyces cerevisiae
cgggccgcaatattagtacaaaattgttcatcatatagttaaaaaatataattaaacttacttataaattcagtataaccatttaatctactactttttgcccctcttcttcacctattttatttacaagtacgaaatcttttcggtcccaagaaccagcgtaattataggattgccatcatctttttacttcttttccaaatgttttttaaaatcggggctatccaatagttccaatactttttgtccgacagcactagtttgagctttatcatcgtttctcagagaatacaattcatcgatattgcttagtgatttttcgaggccattggcgtccgaacccaagtccagcgatatttcggacctttgaaagaagttacatttcattccgacgcctgccatagagtgcttcgtaatgtaagctatcaacatctgtagcacttcggggttcgta

SEQ ID NO: 14745 - DNA, 470 bp, Saccharomyces cerevisiae
attcaatgatttcctttttgttcgtctatacccttcacatactttttctttttctttttcttttctttgcttaacgatttgaattgctcctgttctaataatggcgtcgtcttttagaaaatccttatcaggtgtgaataatgcttaattttttttatatataatgatttacttttattacttcttatttttatattttcctctgtcaaatatgtgactgaaatcttccaatttattaatattaaagtgtgactatcacttgagtttagcgacagtctctaacgcctcgaattcatcgacatgggaaaattggaaagggtatcgtttttacacttcccattttcttccagcaaaaatgatcggcccagagtctagttaaagcatgattaattctcccagggaatttttttgctttactagtaacagtagttctggaaattattaagcgttcttaaattctgggacggtcg

SEQ ID NO: 14746 - DNA, 431 bp, Saccharomyces cerevisiae
ttggataaaggattttaggaaaataaacataagaaatagttatgtatatgtggtaaattgttctagttatacatctatgttacaatatggctggcgttggtaatcttgtgaaacaagcgacgaacttgtcacccttctttctttccacttttttaccttcttctgtggcatttctcattattttcacacattcatcgttttcttcccattctttgctcaaccgttcaaataaaggatgctcttctaaatgttttaccatccactcatgcaggtctttgacgtctgtaattgtgtacacgacaccgccctctttcaaaacatatgcgtactcactcagcaaggtgttagtgataattcttgccttatgctttctttgtttgaaatgaggatcggggaaacaaaaaaacattttagaaagctggcccttttca

SEQ ID NO: 14747 - DNA, 493 bp, Saccharomyces cerevisiae
tctgattcatacaactcattgatccgtgtttatttcccttctcgttccatgtattcttttcttttaccccatgttctcttcacccgttcgaggcagggtttttcctctttttgttataaccaccatctagtcgaatgtggttactcttaatatttttttgtcggccaatgcttcagcgcctttgtcaacacctacttcttttccattcctttcctctaattaaaaatcatctatttagtgtgtacgtattaaaaacatgtcattacattgatatctcattgcaaaatttctcccttacgcacatctttggttattatatatgatgacaggttcgttctccgggtaatgcggactttacatattaattcttttcccagtattttaggcagaatataaaagctttgaggctttaagtgagacaaaagtcttaccatagcaacacgagggctcgccgaaacttccatctaaaataaagagtgcccattaatgtccg

SEQ ID NO: 14748 - DNA, 446 bp, Saccharomyces cerevisiae
gtataatcagttctgtataccaccacatagttctgcattttaataaaactctttctttttatacactgtaggtaaccaataatataactattgttatcatcgtgcttgcgtattttttttctttcgggtgaaaaactccgcagtatttctcgctctccctggataataagctagaaaaaaaaaatatatatgacagatggatgagtaatcatattcaataagtattgtctggcttctgagacggcggtaagatatccttaagagttgcaatggtccttttacacaaaagcacacatatatttcctaccgattttgcctctgtttcacgcgccttttttaatagataccccaatccatactccccccatgtactatccatagacacaatatcaaggaacgttgatcaagaaggaaatttgcgcacaacgaggctgttgaaaaagtcc

SEQ ID NO: 14749 - DNA, 447 bp, Saccharomyces cerevisiae
ttctgatcactttggtttttcattaaatagagatatataagaaattttctaggaagtttttttaaaaaaatcataaaaagataaacgttaaaattcaaacacaatagttgttcgctatattcgtcacactgcacgaacgccttagggaaagagaaaattgaccacgtagtaataataagtgcatggcatcgtcttttacttaaatgtggacacttgctttactgcttaggaaactacttatctcatcctcctccattccctctccttttccaattaccgtaataaaagatggctgtatttactcctccatcaggtaatagcaattccaccgaccatactcacacacaagatgaccacgacaaagatgataatgatatcaagaaattctacataaggccaagtttaggcttaaaactgtggggtccgctcgtacccgctcctgataac

SEQ ID NO: 14750 - DNA, 455 bp, Saccharomyces cerevisiae
aatatgtttgaataatttatcatgccctgacaagtacacacaaacacagacacataatatacatacatatatatatatcaccgttattatgcgtgcacatgacaatgcccttgtatgtttcgtatactgtagcaagtagtcatcattttgttccccgttcggaaaatgacaaaaagtaaaatcaataaatgaagagtaaaaaacaatttatgaaagggtgagcgaccagcaacgagagagacaaatcaaattagcgctttccagtgagaatataagagagcattgaaagagctaggttattgttaaatcatctcgagggaaaaattcaaaaatgctaagtgcaatttccaaagtctccactttaaaatcatgtacaagatatttaaccaaatgcaactatcatgcatcagctaaattacttgctgtaaagacattttcaatgcctgcaatgtctc

SEQ ID NO: 14751 - DNA, 496 bp, Saccharomyces cerevisiae
gattacctttacgtaactagtctcttcgaaaatgatgtttattgataattattatacatggtttcttgccggttataaaattacgtatactatctaagcatctaaaaattagccccgcaattatgtctgtaaacgataaattacagcatatataccctcctcatgtcgttaaaagcattgcgaatagatagatgaataatgtattaaaaaaggagatgtttgtatgatgtccccccagtctaaatgcatagaaaaaaaaaaattcccgctttatattcatgatctttcacctcttagtcttctggccaatttgatatccttcttttggatagtaacacgcttagcgtgaatagcagccagattagtgtcttcaaacaaagagactaagtatgcttcgacggattcttgcaaagcaccgatagcagaagattgaaatctcaagtcggtcttgaaatcttgagcgatttctctgaccaatctttggaaaggtaacttt

SEQ ID NO: 14752 - DNA, 497 bp, Saccharomyces cerevisiae
ttttgatatgtgccatttctttttttttctttcatttagctgcaaaagagatatatatatatatatatatataatctattatataataaaagtcgagtaaaaaattggtctgattgtgaatttaacagctggtcgcaagttctggaatttgttgttaattattgtttcatgttcgtataataatacgatgtttagtaaagcagaaagttcagaatattaaaagtctgttccaatagtgtagcggctatcacgttgccttcacacggcaaaggtcccgagttcgatcctcggttggaacattttaacatcgatttttttgtttgtcatagccagaccaattacgacgtttagaggcatgcactttgttaaatattttttctctctccttcgacatattttttttcctgtttacgtaacattcatccccagtctttgtatcatttttttttttttttggtgatgcgacagcaattctggccgacacagtcgttttcaaa

SEQ ID NO: 14753 - DNA, 474 bp, Saccharomyces cerevisiae
aagtgatgacgttattttccttttttttagttatattatctttttattatattctattctctctactggggagaaattacttaattttcatttatattaaaataatacctactgtttcatactttcactttaaccaccatttctttaagctaaagtttaggaacgctaaacatatcattgtttacttttcgaggaaacataactttcaacatcaggctcttttcgttttatattatctatattctatatagtagtttatagaaatgcatttaacactaaataacagacaagataacgttttcagagtcgaactggattattccatcttggttgtttgatttggagatgcaaacgctaaactcgtaccggcctttttcaattggaataatttctaagttaatttcagaaactttggttgtactgattggtttagttaacgaaccattatacaaaattcgtctgttcgatcttggt

SEQ ID NO: 14754 - DNA, 500 bp, Saccharomyces cerevisiae
cttctacattgattacaaaagacaaaaaaagaaaattttaatcttgtccgcagttttatctgcgtctctacgttcttacgtttcttctattaatgccatttcagttacaacctagtcaattgtcgatccataattctaatcaaatttgtttttcctctatactacctatctatttttatctatctaagtacatttatttactcaaacagttccgtttcaaagtgttttatattaactatatatgcgaaaagctggcgtcataatttcacgtgttataatagccatgctgacggaaaaaaaatgtgaaaatcgctacaaagtccgatgactacgggcagtagcatgtaaatgatggacacacacacacacatatatatatatatacatttacttcaataaaaggctgtgccagacatttttgccatacattgttcatgaagtgtgcaaaataagagagtgtataataggataaaaaatggtcaaatcgctacagctagccc

SEQ ID NO: 14755 - DNA, 450 bp, Saccharomyces cerevisiae
gacgactgtgctcatctcccttacataccagtatatttacatacgccctctactgtaatacaatatcattctatagcactcgcatcgcgtattttttttttattttcttgctttatattgttctatttttcttccttattcctgcctctggatttccctcgcatgacaaatagcgtggaaaaataaaggatttccagtatttgaaaaattttcagtattcttacgtgttcctaactcatatagaccgctattgtaataacgctatcgcttcaattacacacaaacatacacgcacccacaatgagcatcgaatactctgttatcgttcccgcttaccatgaaaagctgaacatcaaacccttaacaaccagattgtttgccggcatgagccctgaaatggccaagaagaccgagttgatctttgtcgatgacaactcacaggatggctcc

SEQ ID NO: 14756 - DNA, 414 bp, Saccharomyces cerevisiae
atggggatctgtgaaattgaaataaaaatatatcgtccatgattcacgtatttactcttattatgtgtatttaattaatctttaaactaaagacctctcagtcatcagattatatgctgttttcattccattaatcaccttctaattaaaatcttgcttcaaattatgaccggttgttcgagtcttttcctcctcagctaacttttcacaatactttttcacccagggttgatggaaaacattcaactcaacaacttcctggagcttattgtaccaatcacttttttcctcattagagcattccgcgttgaaagtaattctttcaccatcgtcaaatactagctggaagcattcattaaagagtacccaatctgtaaaattcctttgccctccattatccgcctggatgtcttc

SEQ ID NO: 14757 - DNA, 432 bp, Saccharomyces cerevisiae
caggaaccataaatgttcaaacctttataaagattttatattcagagtttataaggtctagcttatatagtcagtatttttaatttaattatattatagtttatcctatctcaccgttttagcttgttttctgcgcccaaacataaaaatcaagaagcgcggataatttatgatcagctcagcgggaatgttaatggcagatacttagaatttggtggaaacgattttcttctctaatcctcatcagaggagaggtaatcgagcaagggaccaccaagcttaccaacagatggctttgatgaaatattttctctactgatattttttttcactttcttcaatttttctataaaatcatcactctccattccattatctaatggcaatagtcttttcttgacattatcaacacttgcttctggaaatgtcctg

SEQ ID NO: 14758 - DNA, 402 bp, Saccharomyces cerevisiae
tcaccctttagagagacatttttgatttttttttttttttttttttttttttttttagaataatgcatatttttatttgatatatacctatgtaccaattatacgaatgcttatgtctgttttggatctggtcatccaaagcaatttctcagatgacaatttttttttcctattttctgttacagttcatcattatgctgaagaaaaatgaaacatggcggtgaataataaataacacattcgtacaacaaatcttgtggtagaaaacctaaaaaaaaccaatacgatagaaaatggatgaagtcttaccattgtttcgcgattctcatattccacagattaaagattatcaattggagttacagaacgatttgactaaaaccaatgaggccttccaaaaga

SEQ ID NO: 14759 - DNA, 478 bp, Saccharomyces cerevisiae
taagatcttcactctgtacacgctatatactaaataacaataagaaaaagaaaaagaagcacaatataggaaagcgttctaattaactaaagaaaaaaaaaaaataaaaaaaaaataaaaaaaaggtaactaaaaaggacaaaaaacataacagctgtttataaagtactttatacgtaagaaactactggcactattcattccaataaaaggacaggtataaagtgtctgcttatcttctcgtcttttcggcttttaacttctcaagcttttcagcctctcttctagcatctgcggcggcctgcttttgtctcaagatttcggcgtctgactccattcttttcttaggatcaccactctttttctggttcttagccatgtccttttgttttttcaagtttttttgtcttgccaagtctctttgattacctctagccattgttaaagatgtatcgtcttgcgacgtaatttgttgctc

SEQ ID NO: 14760 - DNA, 416 bp, Saccharomyces cerevisiae
acaatataatcaaattcggtagagaagttgaaaaaaaagtagatgccatattatattacagagaacagagtgttacgccaacatactaaaccagagaagtaaaacgttttacttatatataatagtattcgtaaatttataaaaatcaaaaaaccaatataagcctggttaaaaaaaaaaaaagatcagtatcgtaaagtcgtaaagttaggtcattgtttttggaacctttgtaaaatctcctgtggagttggtgactttatccttggagcagaattaatgttagaaatattggaaagagaagattgagatggagatgatttcggtggcggagcttgagaccctggttgtagttgctgcagttgctgcacatgactggactcctcctgtaactgctgcctttgctgttgaatctg

SEQ ID NO: 14761 - DNA, 406 bp, Saccharomyces cerevisiae
attctaagtaaaaagaacggattatgaaagaaaacgcgcataatatatatatgtatgtattttctaatttatattagcaactaaattaaattacatcaatactattttttttttttactttacaaggtttatttcaaagtcttcaacaatttttctttatcatcggtagataacatcttgataacttcagataatccatcaatagcattgtcatggtcgcttctgatctttttagctaagtcttgagcgaatgactctaatttcaaaccctttagtttatcgtccaaagttttgtagttttcttcaatccatgttgcgacttgcctatcatcttcatggtccactgaagcagggtaccacgatctaattcttgcgatcttttctaatcttgatgcttcgcctacct

SEQ ID NO: 14762 - DNA, 409 bp, Saccharomyces cerevisiae
ggcgacaagtaagaaaaatgtaaatatttttatcacaattatgattattatcgttattaaactacttattttcggttacgtagatgaaatagtgttatataagaatatttgagaaagtaaaactgataaataaatataatggaatgaaaaaatagagacgaactggaagaagagaaaaaaaattaaagcaccaaatttactactctggggcctatagatggaatatcaaaggggaagatgagaaaagaaattatacatttcagaaacgtcaatagggtatcatcatcgtggcagtaagcggcgtttttcctaaatcaaaaaggccaaagcaccaccaacagcagcaccgacgactccggcgtttagtagttgaccattttgagcgtgcaaagcaggagcagcgttactc

SEQ ID NO: 14763 - DNA, 498 bp, Saccharomyces cerevisiae
aaaacgcaccaagtaagtaagtaaataaagaataaataaactatatgagtaaaacaccaagcgaggatgtttcattgtgcatccgtgttcttgatgatcacataactgtaaaagaataatacggcacgttaaatgttattttagaatatataaacaccttatgtgccataagcattgagccaatcgctgctgttttttttattccggggcaccttcggaagaacacaggcgcaatttagttatataaggagaagccctcgagcgatcaggggaccgactgcggatcgctttaaggcaaagatagaaggataaatatctgctttggaagatagtcgtatctaatttcccattctgttgttttcttgatctttcctacgctttcgactttcttcctacgcgctttataatagctatgatgttgccaagatccatgaaatttatgactggaaggagaattttccatactgccacagtaagggccttccagtctaccgctaa

SEQ ID NO: 14764 - DNA, 433 bp, Saccharomyces cerevisiae
caggtttacacaatcgcacgtgatcatatatttgccatgactcctcccagtgacaattttgttcttttttcctctttatcgctttcgtactatggtcagtcattcattcattatatacgcgctctccataacccgtaactttttattatatatagactcgtttacaatacaacgatagcgataccattcaattgaagttgtgagaccaggtaacgagacgaacacaactttacaagtcaaataagaaatcatggctggtcaagtgttggacggcaaagcatgcgctcagcagtttagaagcaatattgctaatgaaatcaaaagcattcaaggtcacgtgcctgggtttgcacctaaccttgccatcattcaagtaggcaacagaccagactcagccacatatgtacgcatgaagcgtaaggcagctgaagag

SEQ ID NO: 14765 - DNA, 452 bp, Saccharomyces cerevisiae
tggaattgattgtgtaaagaaatgtatttagtatttttgaaactaacgttttattaacactgcattatttatttaattatacatttcctggtttttttgccctggattttttttttgtgttaccattttgagtacgaactcgtggaattgttaagttttccaagttgtccatcgtcttcgataactgtcccactaactcctcgtttagatcattctcaagctttaattcctttttcaaaaagccaattttctcattcaattcttttgtagagatttcagacttttcgaatttcaatttcaactcactttctaatccattttgtttctcattaagtttgtgtgtctcctcctcattttcccttatagcatcaacggctcttttgatttcttgttccatatatttcttctcagtatcccttgatacacttaccctttcttctttctcgatctcg

SEQ ID NO: 14766 - DNA, 403 bp, Saccharomyces cerevisiae
gacgttgaagccacatccataaataatttttacataaaattacgcctcgtatgtcgttctcaagatttatggtagagatcacactcagtcagtaaccttttaggcattgattctagtaactgtcgaacattattaaccttgatgtttatataaagatataaaatgttgggacagtatacaattcatatcgtttaaaatgatctatacatgtcgcgtgaagtcataaacagggatttagaagtgaaatcttttggtagtataggggaaaactcagcttgaaacttttcgtaattgagtaggccaagttgcaaccgtgtgaaatcgaatcatgcctgactctaagtacacaatgcaaggttataaccttgttaagctattaaaaaggctagaagaagccactgca

SEQ ID NO: 14767 - DNA, 482 bp, Saccharomyces cerevisiae
acttagtgatcggaacgagctctttatcaccgtagttctaaataacacatagagtaaattattgcctttttcttcgttccttttgttcttcacgtcctttttatgaaatacgtgccggtgttccggggttggatgcggaatcgaaagtgttgaatgtgaaatatgcggaggccaagtatgcgcttcggcggctaaatgcggcatgtgaaaagtattgtctattttatcttcatccttctttcccagaatattgaacttatttaattcacatggagcagagaaagcgcacctctgcgttggcggcaatgttaatttgagacgtatataaattggagctttcgtcacctttttttggcttgttctgttgtcgggttcctaatgttagttttatccttgatttattctgtttcattcccttttttttccagtgaaaaagaagtaacaatgacagaagataatattgctccaatcacctccgttaa

SEQ ID NO: 14768 - DNA, 486 bp, Saccharomyces cerevisiae
aaacgccattaattgccactgtttatataaaagtacataaaaaacagtaaaattgaaaattgaacgcatttacattttcgtgtttctaccgtaaagcaaaacgcttacagttttttcttacctattgatgcgaataaatcctttggtttcatagaatgctggaaaacttttctccttaagtgcgttacattttggttgacactagcaaccgtgttaatgacagtatgcttcttactcaaatcgtccgcgttcgcatatgcttccctaacgtgactatgctgcttatactcctcagctatgaaatccttatccttattagaggatgattttagcgtataatttatccatgtttgtatccccgtatcatattcatctagctcacgcttataatttctcaactgttctatcttaccggcgtgcgaagtcttactgttcagtagtttattcatatctaatttcggtaagttattctgctgccccaatttc

SEQ ID NO: 14769 - DNA, 408 bp, Saccharomyces cerevisiae
ttaattaatgtcttcctctttgtctcgtcaatttcaacgcctatctctttgtctcttcttttgtcgcagcaatacgcacatatatatatgtatcttataaaaatatttcaaatatatctcaaaaaacatagaatacgtaacacaatcgaacagtaaaaacaaaaataaaccggttttttcacgttactcttgggcacttaggtaccgttctgcatccaaagcagcaatgcatccggaaccagcagaagtaactgcttgtctatacctagagtcctgaacgtcacctgcagcaaaaaaacctggcacagaagtcagagacgatccaggcacagtttttatataccccgtctcttcttcatctacttgtcctttaactatatctgtggcagggctgtgacctattgcgta

SEQ ID NO: 14770 - DNA, 491 bp, Saccharomyces cerevisiae
aaacaaaaagcacacaaagttgcatattcagaatttttctctcctttcccttttctttatattctctttgctggtaagccaaaatatgtaccttatttaggttttagtagttttcttttttctttgttaaaaaaatcctgatggaaaaaacagtaagcagaaagcaccatgtagtctaatgaatacaaatagaagtgaaaccgaagcaaattcacagtgcacgatgagtgatgaaggtgctgataaaagtctagatactaacacagaatttattatacaaacacgatctaggaggtctaatgccggtaataaattacaaaaactattggagcaggagctaagagatatagaatctaccaaaagacaaatttcttcctataagaatggtaatgatgatgaagaagatgaaatagggctgttgtttcaggaagatgaagatgatgaagatttcgaaatgatggcaaaagatgacgatgatgaaggggaagaaa

SEQ ID NO: 14771 - DNA, 485 bp, Saccharomyces cerevisiae
tgattggggtgtcaacgtaatgtacttttctccccaatttttcttttcatccgtatattttaccgtaaaatggacaagctaatagcaaaacgaaaaaacacgttgtcacttctatataactttgcttaagtaagtattttgtctttataatgttacatactgtgaaatacactctttagaaaacactatttcctcactctcggaagcagatttcgaagttcttccttacttctgagctttgcttctccttccttgcgattaatgttacccggtatacgaaatcggagaggatcagaataaatgcattgaaaggagcataaatctatacagcggtttggcaatggtgagaggaagagaacaaaaaatagaacgcagatagtcatgtccaaatacgcttggtataccagagttacagatacattacatcgtctaacggtactgacgttggttggtggtacgttatacatgtcgggtggcttagctta

SEQ ID NO: 14772 - DNA, 490 bp, Saccharomyces cerevisiae
cgatgatacattgatttgtttggagcttcctgatttaacatatcgttgctttccagcaaaaggtaaagataaatactaaactgtatacatctataagtaatctcggccattattttaacgattagtacttttgttcgtgtcatttttttggaaaattttgcgatctctcactgttgaagaataaagatttcgcgatgacttttgcttgcagagaaatgcctgaaaacacgaacattcaataatatagatggtacataacatatgcgcaagaaaacgtaaaggccacggatgaagcatttctttaggctaccgacagcattccggcccatttctagggtttccttacgatattctagtactgataccgctcaaccaaaaatatcaaaactcaaaattagttttaataaaatttctgaatcaaatagcgaaaaaaaagataatttgggttcaattgacacacgaaattgtctttcgactcagcaagatgaca

SEQ ID NO: 14773 - DNA, 423 bp, Saccharomyces cerevisiae
aaataggccagatttgataaaacatttatatatgtatgtatgtatgtatacatcaaagtcttccataaagaacagtttttttatagactatcacaggagcgttaagatttacaagtttttcaatcattttgaggggttaggattatgatgtcgagatggttgcaagcgcctgacgaaatagtatttaattacttcaacgcttgaattctctaaggtattatcgattgtataaatttatggttattgtttcatacttatttatatacatgaagaccgaaagcaaatactcaaacaattgatttggggttaacggtgcgtttggtttagaggagaacataattattccaccttcaatgatagggtaataaccgctttagatgctttgaataagctggatgggcaattttccttccggttaaggct

SEQ ID NO: 14774 - DNA, 465 bp, Saccharomyces cerevisiae
tgccagtaatcctacaactaagaaattatactaggcattcatacttattgtttaatatataaaatgaatagtaataagttgatgatagattgatttttttaacccattttacacatatcttatgaaagtgatattaacctacataatctaggaacaatataaaaacacccatgataatggcaccataagtggtcattttagcagttcttccagcagctcgtttcgctttacgtaattctttatttcccttcttaatattcaattcaatgtcatcttgattgttcagcattaggtttatattttgagattgcaccgttaaatgattggacaattcgttctgtatattgacaatgtctaaaattgttttgtttatagtctccacttttttcaattgctcatttttttgatttagcagttccgaatgttctgtctccaacacttgtagttgctcctgggttaatttgg

SEQ ID NO: 14775 - DNA, 488 bp, Saccharomyces cerevisiae
ctactcgcaggaagagttcattacgcgacggttccaagagcgtgaaagaattgcttctgcgcataagtcttcttccataatagatttttatatcatttttagaacataaaatttctcgccaagagttttttaagtaaaagcagattatccagtaacatgggttccgctttttgagcgaatactatgaacgagttttgcccgtgctccccatgactcattagattctttgatgacaaaagatcactggcagaagtctgtttcgcttcttttcttttttttttttttttttttttttttcgagcagattgcaatcagcgatgagacaaaaatggaaagtaggtatgggctgacgattgcctaaacggttatcaattggttactataaacgcctctattatatgaatatacctatttattgaatcccttcattaatatttaagaagacagaggctatatatcatctggatcaaaaaatgacagcgccattg

SEQ ID NO: 14776 - DNA, 497 bp, Saccharomyces cerevisiae
aaaaaaaaaataaaagcgacgatatatcgtgtatgtattaactaaattaatagagatatacaggattaatatcgtttgagaaatctccatagagaaaggccacgcgcgactgagcttttttttttttcaacaatcagtatatacatttacttccggtacagcatcgcacttgacagtccgttagtaatgaatagaaaagtttgaactgctaaataaaaatctgtaattatcacaaaactaaactatgtgatattcagatgtttgatacccttgtgagacaaccgttcgcaggtaactgttaactctggaatgggtaaacagtagctcacagtttgtgagtttgtttgatttgcatctctttcaacatgaatggtggtaaacaagccaccagaagttactggataagagttaatttggtcatcgttttccaatttctgtagcttttgctgttctgtgatgataccaggaatgactatatcaccaacctttacgcctaa

SEQ ID NO: 14777 - DNA, 412 bp, Saccharomyces cerevisiae
taattctgcgactgtgggcgaagtaaatatgtaaatgttcatgtattagtaatttcataggtttacgattatcgacataaaatctccgctgaaagttgcggtgcgatagaataccgcggattttggaaaattgcgtttgcttttcttatcacataaattgaatttcataagttttggcttatcttggataaggtacatcgtgaaagtatcacaaagattggatagtttcgtcaattggtgaagcaataagtataaaatggggacatttacgcatgtagtcttaattcttcactttctgtgcagttgatatcacttagagtatgtgtcataggcacggtaaagagcactgaacaatggtgaagataagcttggacaacactgctctatacgcagacatcgacacgactcctca

SEQ ID NO: 14778 - DNA, 435 bp, Saccharomyces cerevisiae
gtgtaaaattcaaagtaatttccatcggactacgatgttaatcagatatatggtagaaagctctaactttttacccttgccaacatgcacgcatatatgtgtatgttaaaataagttctgtatttgaaatgcatgtgatttacaatcctcttgcaatgaacttaatatcattaacaggctaaaaataatatatgatgtagatctttttagtttagcataatataatctataaatctataatatttttattctaaattattaaaagggcggcgagagaagtgtatctgtgcttagaaaacttttcgtttcttcgtctcaccctgagaagtgccttttcgtttcaaaatcattactggtgagtgtcattaaactttttcaatttgcaatttccgtatctttaaaatttcataaggaagcgtgagttttaacgtgctg

SEQ ID NO: 14779 - DNA, 478 bp, Saccharomyces cerevisiae
attaatgcttttgcctttagttttttacggtcatttatgtttctttcatttaaattaacagacctaaatagcactataatttactatctgctctatctgaccaaccgactctttttaagaaagcaattaaaaagcgataataaccgcgggcatgtgtttttgttaacatgaacacaataaacgtaagaatgtctagcaataaattcaaaattattatcttttttttttttattgttatgtactatttttttttttaaataaggttacaattcttttttaattaatgggatttaccaatttgaacgtgatccgtaatcagccaaacgggatataaaagtagaacaatagaagcgaggaataagatacgaatgccggataacaaagcattccttagtgtactagattaagtaaaaaataccgaattgttccaaaatatcgtgatatttgaaagtgaagtactcgtttatttcaatgcgcg

SEQ ID NO: 14780 - DNA, 464 bp, Saccharomyces cerevisiae
ctctaagcgagccgacaccgcctggaagtttttcataaagggatacaatatagaaagatgtgtaaaaacgttaagtaaaagatgagcaaatgaacagtgttcgaaggagaataacaagagttactgctcatataaaactaatatactaaaggttttcgctttgtattacgattgaaacaattaactgttttttttttttccgcttattacacagtaccggtttcatttacgcctttgatcattttattggcattgggctcatagtagttttcagcgcgtggttaagctatttaacgaaagcgtataaagtcaagtgatcatcttttgccctgcaaatagagcttcaaacttaacattcttcttcagcatataacatacaacaagattaaggctctttctaaaatgaatcaaagcgatccgcaagacaaaaaaaatttcccaatggaatactctttgaccaagca

SEQ ID NO: 14781 - DNA, 440 bp, Saccharomyces cerevisiae
aatatatagcactagatttattttccgatatcaaattcagttacttatataaagttaaccacttgttacttcttttttcgcagcgataacggtaactattattgttagctctgtttatgcggaaaggttatatgatcttcggtgcaagatttagtgccctatttagtcacccggacatctattgtttgatggtggggcaatttcgagagatgacttatttaagcataagacagataataatgcatagaaggtggatatacgtaatgcacattaatattatagtggcactgaagcaaaattcagaaaaatttaaaaacatataaatataaaagaaaaaaaagaagaatttcgagactgctacgaaaagtgaaagtaataacaagcgtgcaaaagttcataatatccataatagattggacatagaaattaccgcaaagcgc

SEQ ID NO: 14782 - DNA, 482 bp, Saccharomyces cerevisiae
acctctccttggagattctgataattttatgaccatgacttctcgtgcaccttacaggaaactttaatggcctgataagtacagctatattgtgatcacaattattaaaaactaactcatttcatctataaccaagtacaaatcgcacgactatcatgacgataaaagcgtatatccttgatttaattcacatcacaatcaccccccttgaaaaaaaaataaattttttttcttgctataatagcataattgtccacaagttcactattagtgctatcattcttccccactgccgcaaaattgcaaaggaaataattgtttgccctgcaggaaccatatactaaagaagaaatagatgctattagcctcttcaactgtccgtaatcactacatcttgaaaggtaaaatgcaagtagcaatgtgtttacttaaggaagcgcatctacatcttctttagaaccatctgtcgattcaagcggatt

SEQ ID NO: 14783 - DNA, 411 bp, Saccharomyces cerevisiae
gaaatttttagccaaataaaataatggccaaagaaatgttgttaacaacactaataacattaaagtttaatacaaccacaaacgatatacataaatctacataataattttaatacttcccacaagtttgcctaaaagtaaataccattttttgtgtgcttattccgctgcgatggttactactacatgtaagaggtgctcagtaaaaggaagtacaaaacgtctttcgcgtttacctgtgctccatgcgccttaatcaatactctcaaggccttcttaaccttggcgttttcttaagtgttctgttcacattcgataacaaaatttagaatgtcttttcacccctcttttttctggtaatggttcgaatgtatgcggtacctttttttaacaatagtcttcagggcaccc

SEQ ID NO: 14784 - DNA, 459 bp, Saccharomyces cerevisiae
tccttttacttatataattctcatcgtgatttactaggtaaatgtagtattcaaaatctccaatttgtactctttaacttcaccttcacatattatctttttactcgatgtagaccgcaccatcattacttgctagcttataactctttttttaaaaactgtttggagaaataggtgatttgtttgaagttgtactcgaaatcttgtatgtcaccataccaaggatcttcaataatggtctgcacagtgccatcattagtattccaatcaccaaaaaggcaaactttagctttagaaccttcaggttgtattttttttaggttattaatgttggattcatccataccgattatatagtcatattcatcgaagtgtttggtctttatttgtttccctttatgattaatcttgacgccatgttgcttacaaatggacactgtacgatgatcagggctttcc

SEQ ID NO: 14785 - DNA, 415 bp, Saccharomyces cerevisiae
acctaactattaaagaaagaagaaaaaattcgaaatgaaatcctaggcgaaattgaaaacgaaaatgaaaataatggagaaacttcgtcataaaattgtgaaaatcaggtatcatttgttctcctagcattttctttcctagaatattactattttctacctccattcgtattttacttttcctatttaatattaaatttttatataccgttattgccccttacggcaataatacaaccagataaaagagcgtgctccgaagttagcctgttatatatcaacaatttgcaaatgtggttacccacgaattattggtgttattttagtgaatagcttgaaatctttgaatgtaggaagcatccttatttatcaagaaattggagaagtggcggcatcgcgtggagactgcctatga

SEQ ID NO: 14786 - DNA, 442 bp, Saccharomyces cerevisiae
tttttgcagacatttttgatatatattcaattcatattttatctcttttttttttttttttttcagacgtggaatggtgggaaagccaaaatgtcactgaccgcggctaaaagttaaaaaatacatgagacgacattcttttatgtatatatatttacacatgtatacaaacaaatacacacgcaagtagagaggagttggtggggggaagatgccattatagaggagaaaagaacaaagagagtgagcttgcaagataaaatcactcgaaaaaaaaaatttcagtgacttagccgataaatgaatgtgcttgcatttttctaattatccttcgtatcttctggcttagtcacgggccaagcgtaagggtgcttttcgggcataacatacttgtgtttttgcatatattccttcaatccctttggacctcttgatccgtagg

SEQ ID NO: 14787 - DNA, 431 bp, Saccharomyces cerevisiae
gaccgataaaaagagattatacggaaaatcatataaatgtgtttatgtacaggcaagtttacgtagactagattactttaattgaatatatgctctgtgagcaatggctgtcttgtgaatctggtccctcttttcaaaggcagacgaagtgcctttggcaatggcagtgagttcttctcccaaacgcacggcgaagtcgctcgacactctttggtttgcgctttgtacgatccagttccacgcgatcctatttctttgcctcttgttcagaggcacaggaatgacagaagccttggccacgcctgtgttgaatgtcttggtcatcatcagcggagctagttcgtcgagtgacttttccaaagcctggatggggtcctgccgggtctggcagtacaccagatataaggccctggacagaatggtttgtgcct

SEQ ID NO: 14788 - DNA, 490 bp, Saccharomyces cerevisiae
tcataggtatttgtaaagtccaagaaataactttaaattcggaagtgccagtgcccatgcttctcttcgcaagtacatgtgcgcagcagccattcatatatgaaaatttaggaatatctattgtatatacatgaaatttcttcacaggtaatgataatctagtgctttttgcttagtaataaactgtttcccttttattaaagtcagaagtatatcattccacttgcagttacattttttgtacttaccaagagaaacaaaaaatccgttaagttcattaatgttcgtttgattcaattgatttaaagattgggccaacttagcgcgcttgtgcccattaacttctagatctctcatcaccaagctaaatattctctccttgtcaaagattacagaatagtttgggttggtgtttagtgacgggtaggatcgatcgataattgacagctgctcactaatcaacttttttattatatcttgtgctccgggg

SEQ ID NO: 14789 - DNA, 494 bp, Saccharomyces cerevisiae
taaacagcgtgagggggccacagtcaagcaaatccaactccgccacaagaccgagtgctattttccatggctctcccccaaagctagttaataaaaaataagtaacaaatcattatagtaattcttaatcgatatctatttaagaagtgtaacagcacatgcaatgaaccgacttcgtcattcattacctctgcttttccctttttcaacagtcacgtgcgcatctcccttccgggtaagcaccgcacatgccaaagaccctatcctggctcgcccactcactcatctccattagagactcaaccacatttgtgggtgtgttacagaagttacaccatacccactgtcctggtccgcaacagttgcaaaatcaatgatgcctgctaccgtcatgctatcatgacaaacgatggcacctttgccaagcaaaaaactgtaaacaaaaccaaaccaagaagtcccttggggttgtgagccatattctccatctgcgt

SEQ ID NO: 14790 - DNA, 467 bp, Saccharomyces cerevisiae
gactaggggacacttcattcatttatggtatgccaatatttttaagaaaagaagaataatacgcgatattgttttttaaggaaggaacgcacactcgcccagttagagtgctgatgatatatacatatatatatgtatatgtaacaaacaataagaaagcaatgatacaacatagagatgagagagagcatatatgtcagcgacgagatataccaagatggaagctgatctcatgtaataactgcggggtgtactttgataatttttgggattccattgttattaatagctttgatatcagacatacagaataccagagattttcctcaaaaatatggcaatgcacaaagggggatcaatagttatataaattaagattattacttcttctttgttttatgtgttgttattcactatcccactgcattatcaatccttacatatcagcttccgttaaacccgatgac

SEQ ID NO: 14791 - DNA, 405 bp, Saccharomyces cerevisiae
aagaaatagacattttgtgtcgaaaaaaaaaaaaaaatagatttatataaatttataggactatttcatagagagaaaattcaactagaaataggtacacgtaacctaaagctgcttgtactaaaatcatagcgccctgtatcaaaaagaagcttttttcttttgttgggtatgtctatatagagcacatcctatattcccttcgaggtgtttttacaagaacaaataaagaaacaaaccgcggtgtgaggaagttcccttaaaaatggcaaagattaccgtaaaggtaaattactcctttaacgatgcttaaaacgagcatcttactcttgcaacgaaattaatcactcaatttcaacgaggatgttggcttcccatcaaagtagttttggggtaaaccgcata

SEQ ID NO: 14792 - DNA, 453 bp, Saccharomyces cerevisiae
tgacactttacttaatcttttccttcgtactgaacaattaatcaaaaactagaatatgtcatttctatttcttctatattttttttacgttgttgttgtttttgttgttgtttgataactttatacactccatacttctttataaaaagttttaataccattctttaatacaaccatgtttagtgagtactagctcctacacatcagatcgtcaagtacattatgattatgattattattaatattatcagtacaattattatgtgctggtagttcactaaaaaatatgacgcacacaaagagttctccttatgccctatagaactgaaatattaggtgctaacactgacaagcgctttgttcctgctcctctgctgtagaaatatcaatgactcccggtttattttggtttgcactatttgcattttcgctatccaaaggagttgactcgct

SEQ ID NO: 14793 - DNA, 500 bp, Saccharomyces cerevisiae
gtttggctttcctatttctttttcccttttttttgactctttttaagcattggttgatactttaaatactttattgaattagcattgatagtatataataaggtttactcactatatagtagcatcatttattatttaatgaagtacttaaatgtttcgctttttttaaaagtcctcaaaatttagcttgaagcggaagagcttgcactagcaacagcgacttccatgtctttatactcaaatgcgaatggttcgtatggtaaaccttcacccacgaaaaacttggacatagattcaacccagtgcaaacgtaaggaatgaagcatggcagatgtaccttccatcaaaacaagaactgcacatgttagtgcgaaccacatggcaaaaagtgcaaccgtcataaacacacccacaaatcctctaaatccaaaggcaatttgaattgtcattgtccataaaacactagacaattgagcatgtgccaatgataaggcccataa

SEQ ID NO: 14794 - DNA, 469 bp, Saccharomyces cerevisiae
catgactcatcttataaggaaaaaggtacaaaaacaaatgcaaataactgaaacgcccctcacttcatttaaatatacgtatacaactgattatatacacgtatatgtacaatcaagtaaccccaaatgctgatctgagaaaaaaaattgtgggatatgtgattaaaacttatcttttattatttatttatacaaaatcaatactcatctttaccactaatgatgacgttatcaatctttaaaatcattctacataattgagtagctaaaagaatttgctgctttttgccaataaatggatcaacgacaaatagttccttcatgtcattagacccgtaacctaagcaatcgacaccaatgttggaaatcttttctttcagttgtttacttttcaatgtagacaaagttccgattggatcaagaccagaattttcagccaaagtcattggaatggtgtctaacgcttggg

SEQ ID NO: 14795 - DNA, 474 bp, Saccharomyces cerevisiae
gtggcttgagctgtggataagaaaagccatatatttatataaacatttagatatgaataggaagtagattgttcgacgcaactacccgttcaagaagtataatggggaatggtctcatcttccctcacaggatatagttctctgaagagatacatacgtttgtgtatactatgcttctttatcaactcaagttttgtagaggaagacgttgaagatggtgatgtgacatctttactattctccagcacgttttcagtatttacttaatcgtatattaatgacgtcccttatctattaactttccggtttttctttttttcggtgaatgttctttccgttttagtgaatttttcaattgtaattgacgcaatcggtttataacaagcagacataaatatcaagctcgagccaaatcacaaaaaaagccttatagcttgccctgacaaagaatatacaactcgggaaaatgactgc

SEQ ID NO: 14796 - DNA, 411 bp, Saccharomyces cerevisiae
tagagcgaataaaatgtcaccggcgctactatcccttaggagattgtaacccctctcctgaattaattcaaaataaaattgaaaactgtataagtatatacataaatatatccatacacactaaaaagacatattcatactgccttgaggatagagaacaccattgagcatgactgacttaactacacaagaagctattgttctagagcgacctggtaaaatcaccctaactaatgtcagcatcccaaagatttcagatcctaacgaagtaatcatccagatcaaggcgacaggaatatgcgggtcagatatccattactatacccatggaagaatagccaattacgtggtagaatcaccaatggtgctgggacatgaatcatcaggaatagtggccctcataggtgagaa

SEQ ID NO: 14797 - DNA, 480 bp, Saccharomyces cerevisiae
tattattcgcaagcttctctcaatcgtgaaattttctgtacataaagtgctactttgatgattatttttaaaaatattgttacattagaaaattggtttgtgatttacataatcaggagagtctatatatatatgaatatagctttgagaaagggatgtgaaaaaaagtgcaatatgttcctaactaatgttatcgcatgcattcaatgggttgatctttccgattgtttcttttctaacttggcacggtccaaggcttctcttttaattctcttgtcttcctttattttagattttatttttctacaccaatgtctaaatttatcatctttagacggtgatacgtatttcattataagatcatgatgtagcaattcatgaatcgatgacctttccctttcattcttaatacaacacctattgacaaaatctgtcatttccttggaatagatacggtctttgggtaatcttggtgaaggc

SEQ ID NO: 14798 - DNA, 491 bp, Saccharomyces cerevisiae
gccaccaagtagctatatagaatcaaatctcatacataatttaaagaacgagagtgcaatgtgatgattgtgattcctgatcctatgtcacggacgacgacttgtatcaccttgaattttctgaccaaaggggccgagtcgcttcacgaggggatgagaaaggaaaagaagggaaaactaaacttatataacgcaggtgtgtctttctaccattgccatcaagttattaaaggccacgaacaggaacgctagagacctgagtttgtcatttgtttagttcaaggattaaataaacaatccttctacaaataagtcctttctttcaccatcgtcttaagaccactgcctccaacgaaaactaacctaaaagagtttagatcacgagtattttcgctctttccctccttcccctggttttttctcgttagttcttttcatttaaaaactcttctcttgtcaagaatttaaaagacgaagagtccaacaccgac

SEQ ID NO: 14799 - DNA, 488 bp, Saccharomyces cerevisiae
ttgtttttgcgtgtttctcgtatgattgtaatatgtagataaattaaacataagtatatcaaatgtcgatattcttaagactgtttcgtaaatatgttaaataccggatgtgactacatataaaaagtgcgccttttacagtgataattagcgtcaatcaataaaatatttgtaaaataggaagcgaaatcccgcagatgccagaataggtggtgtataaggcaagaaaactttacctgcataaattagtattgaacaccaatcaagtagtcagccaattgctcgacaatcttggtggcctcaccggcttgtacggttggtggataatgagcaataataacggtttgcttagttcttacacaaacaacaccctcagcatcatgtctaccgtagatacttctatcgtcagctctcaacaacatgaacttttggccttgaatatgcaaaccattgctttgcaaaccagctggattgtcgaagccttgaac

SEQ ID NO: 14800 - DNA, 416 bp, Saccharomyces cerevisiae
cgattgagtttcccataatttttaccgctctcctcttggttgagacgtatgcgaaaagctaattcgacgttttttattgtaaaatcgtacacttttgcaggcaattctacatattatataagatttaagtcggatcttgagacttttggtgaactttgagatgattgttgggattccgttgttgataaaggcaataatattatgtatacagaatatactagaagttctcctcgaggatattagaatccttacaatggacttgatatttctacataaaaatattacgattattcctcattctgttttttatgtttcaccatccaacagatctaaactcatttcttcaggtatttataactttgattggttcatcttaggcatactcaatcttacctttttcatgcgtgtaggaacga

SEQ ID NO: 14801 - DNA, 491 bp, Saccharomyces cerevisiae
aacatcaggatagtgtgcaacgtggcataagctatgtaatcaactactttttattttctatgtacgcatatacatgcattcacgatctgtttcagtgttcagaaaaaaggcacctactgctacggttggcccatacctttattctttgttcttgttacaaacgagtgtgtaattacccaaaaaggaaatttacatgttaaatgaaacccagtaatcagaaaaaacagttaagaaacctaaaatggtagagataaagatacagattcagtggttgctgaaaatcaagtaaaaaaatgaaatagagtcttcatatataaaccgccagaaatgaattaatgagagggatctgtaactgtttctcggataaaaccaaaataagtacaaagccatcgaatagaaatgcaaccatctaccgctaccgccgctccaaaagaaaagaccagcagtgaaaagaaggacaactatattatcaaaggtgtcttctgggaccc

SEQ ID NO: 14802 - DNA, 476 bp, Saccharomyces cerevisiae
gctaagaaatagagataataagataatattttattacactacatgtacaattttacttttactttgtgttgtctctatctgctttcttatttttaatatttaccattccatttataatttgtaaaacaattaacataaaagttttttaaactctagaccagcaacatatcttcaaatatcagttgataaggtaaagtatgttgatagcattctaccgtcacacttatctagcagatctttgttaggtagatctgctaatatattttacgtaagattcgttgtatgtgcgggaaaatttgtatctgttgtggtagtcactcaccctttctatgtattaaaaactgataccttccatactagaaaagacattcagttgaatccttctccaaatcaaggatactattgtcacttctccattgagattcgaaaaacccctcgggtcttgttagaactaaattacgttcataggggtggga

SEQ ID NO: 14803 - DNA, 458 bp, Saccharomyces cerevisiae
aaaatcatacattcatataatatccattacgtacgtacatcttacataacacatttttacccccttttcttttttttgttttccttttttgttttatttagccgcccgcgttttcctaacgttttcccaacattgaaaccaattcgtcatatacctcactttccataaattgtttagattcacagtgggaatgacttcagaacacttcaatttacaaccaaatttcactaaatcgttaaaactactgtgttcagaatatggtacgttaaaaacttgaaatttgttgtactttttgtattgcctcaatatactcgagatttcaaacccattctcatcatcattatctcgatcattcttcattagttctaagcaatattctgtattgccactcatttcattctcatcatcatcgtttttcttttgatattttaaaccaaaattgtgactccacccggtag

SEQ ID NO: 14804 - DNA, 402 bp, Saccharomyces cerevisiae
atatattcatcgatttttttcctgtaaatacaaacacatgcttgtatacatatacatatacatatatataagctcattataaacctgtgtgcatggaaaaaactttgtctgcccttaatttgcaagaataggttctaacaattcctccaattcaccagtctccctcaattcctgcaagtcgtcgttgcctccaatatgtttaccattaatatagatgtttggcacggttctttggccattaatctcatataacgcagcctgaatgtctgcgccttccttcatgtcattcaattgcaaaaccagaactttggacctgggaacctttaacttttcaaaaagcgtgtttagggctgcatggcagtatggacagtacgttttggatgcgacgaagatctcgttttc

SEQ ID NO: 14805 - DNA, 481 bp, Saccharomyces cerevisiae
gaaatatggtaaacagaaaatgaaaaaaaatgaaaaatcaatgaataagagggcttgagttccaggttctagaaatttccctcacttatatatatatatatatctatatacatatagttttgagtatatcataacaggattctctttcaatgaaacctatgttttccgcggcattgcagttaaaggatgttctagtggtgaaaaagagaagaaaagaattcaaagttttcctcccataagtatacctatactttttatctgtgattgaaagctgtataccaacagccttctatatattaccttgtataccattcagtagtcttaagcatcatctaacttttgaccaggtccattctgattggctgcggtagcccgctccgttttccgctctaagcgtttggtacttgtataaatgtgcactggcattatgatatcgagatccccgcatagaaatctcaggaccaaccaaaaattgccaatc

SEQ ID NO: 14806 - DNA, 473 bp, Saccharomyces cerevisiae
ctacccattacctgattgaaagcatctttggttaagaaatggacctgacatgctacataaatagatacgtaaacagatatttaaccgagacacataagatgacctattgcaacaactcatccctgtaatgtgtttgaaagttaacccttttaatttcgcgacggatctgcgtattaatggcatttttctccaattgttgcattttcttcatacccttcttatattgcttctcggtaacaccactgaccatccttctatcagcagctgtaatcgttcttctgctttcgttagggtttggctgcgaaggtaaattttgtctatagtacctctggcccgcacgatgacctagcctagcgcctgttggcaaggtaagttctaaaccagattcatcaatagatacggtggtatagtttgcattaatgtcattttcggatgagaccaacgtgatatctacctccccatcttcttcatca

SEQ ID NO: 14807 - DNA, 405 bp, Saccharomyces cerevisiae
aaatatacgcgactataactttttcccaacttttatacaaaaaactacaatttatatatgatatgcaaataacacataggtttaatcttcactgttcaacttttatagttgtcaaaaaattcttttatgccactaccgattcttttggaagcttcaatcaactgatcatcatcccttgcataggcgatggtgagtcttagaaaatctgaattctgctttgaataatttgggcaaacagccattttataaccaagcactactttaacaccattcttcagcaagaacttatctaaaatatccatctgttgcggcaaatcgtcaggtctatcgaaattcccccaattgattttaataatgatgaacatacccgcggagggttccataacggtaaactgaccagcttgg

SEQ ID NO: 14808 - DNA, 487 bp, Saccharomyces cerevisiae
gcgtaagagatacgtctacgatagcatgtaacagcgtatatataatctatatgtattcgattaatccaacacttctgttgtgtagtctaatgttcgaaaaaaaggtacgcttccctgttataatcaggtatatttcgttattcttataagctaaaagattaaaaatttttccactttccttgaaatttggtcggttcgtggaaaaatattattacgtattgaagaagtgcatgaagataaaagatgggattactggaaaaataaagggaggaaaatcctgcagaacgttgttgtttcaatcgaaggtttcttcattcgaaaatgggttcttcagatgtttcaagtcgtgaatgttcattggtttataatgaagatcccgatttcaccgatggcacaacaccatgtgatcggttgggagtggacttgatgaatgttctagatgacaaggatgaaataaagcaagagtctgtcccagtctcagatcgtg

SEQ ID NO: 14809 - DNA, 462 bp, Saccharomyces cerevisiae
ttttccgtactctccaagataaagggaaagaataatttaatccattttcataaccatttaccttcataaatgttctattctttttttggctatatattaattacatttttaatatcatatcattgctctatatccttcttgtccagcctctatgcagtattttctttcattctattttggggcaaacttctgcgctgagcggcttatcgccgtcggagtgacatcaagtaccatagaaaagtcatcgtagacttacatatttaggcaagagaaatagttaggtaaacagaaagaggcactagcagaacgtactacggtgtggtttatacaagagggttctgtgaataatggctgcaagtgagataatgaacaatctgcctatgcattccctcgattcttctctaagggatttacttaacgatgacttattcattgaaagtgatgaatcgaccaagtcggtaa

SEQ ID NO: 14810 - DNA, 420 bp, Saccharomyces cerevisiae
ataaaagggggcagaacagtcttcaataaacatttaaatagctagtttattataataatgtgatcgtttctttcttccacaactcacatatagttatttgatattatcgcatcttcgcttctctatgccatgtttccatcaatacttatgttttatttaatacatatttgtatcagtatatcatatcatttcatcttcttttgcttcgatttgtaatgtttgtgcgtataaaatcaattgcgtagttcgaacacccgttaatcctttacttcttaccaatggcacctaactttgcttttctttcgaccttactacgacagatttagattcaaacgatgacgctaatatcaatagccaacatggaagccaacctatacaaagtacaaaccaactccaacatttcaaatccaaccatgctga

SEQ ID NO: 14811 - DNA, 466 bp, Saccharomyces cerevisiae
tataccatgtttgttatatagagtttatatatcgctcattacgaatcggtgcaatgagctcttcgatatgaaatattccttagcttagtaataagagtgacttaagctgatgccgttgactgcaaaaggaagtaaatagaagtcaataacaatgaatgactaccatctcgaggataccacgtctgaacttgaagcattaagattggagaatgcacaattaagagagcagcttgccaagagagaagacagcagccgcgactacccattatctttggaagaataccaacgttacggaagacaaatgattgttgaagaaacaggtggtgtagcaggtcaagtcaagttgaaaaatacaaaagttttggtagttggtgctggaggtttgggatgtcccgccttgccctacttagcgggcgctggcgtgggccaaataggcatagtagataacgatgtggtggagacttcc

SEQ ID NO: 14812 - DNA, 438 bp, Saccharomyces cerevisiae
catagaattgttcacgtggtctaaatatgtatacatatatgatagtttatagattcatactgagacaagtgaaaaaaaaaaaatctactatcgaccttctctcttttcgcggcagcaaaaatgaaaaattaacttcaataaaaaagttgaatactttcaaatattctaattgcatttaatatttaagcaacaaaaggacagcgataattgagtggtggcttaattctatactccaaagtatgtcccaatctagtaggttaagtgcacttcctattttccaagcatcgctttcggcaagccaatctccacgttacatttttagttctcagaatggcacaaggattgttttcattcaagataacataataaggtggtacaatgtactcactgattcactttaccacagtttgaactttagtcgtcatctcgtcttggatg

SEQ ID NO: 14813 - DNA, 496 bp, Saccharomyces cerevisiae
gctaccaaataatctatactaaaaatgaaatatttttttgttttctttacctcattcaactgtatagaacgttataacaaaataatcaagttaaaacccttttttgtacacaatggaatctcttccatttactaatcaacttaacaatgctggattggatatattgataacgttttaaaaagcgttgcgtgatgtttgggtgcaattggcggaaaagcggaactttcaaatttacgataggtggagatacatctccacctttctccccattatctttgaattttcctcaaatatataaagagaacaacaaatccatagaaatgccattgtttaatcctgattatctacattgttttagttttttactcacaatcgagtaatgcctttgtttggccaagctatgtgcaaatatcacaaattaaaaatttggttaagcagttaggctggacctaatattttagaaaaacctaattttttttgtggacccattttcgat

SEQ ID NO: 14814 - DNA, 408 bp, Saccharomyces cerevisiae
gctgctatttagcttttctaatttaaaaaatttataaacttcttatagtatttcatctttatatcaaatactattagcaaaataaaaggaaaggaaagggaaaggaacttctttagactgcttcgcactgattctatcgccatccttcttcatgttctcaactattggatatctgctctatttagaacaatcgttattgttacccgcgttaaatggggtaactgattgctgcttttttttctcgttgttttggaccttttcggacatgagaggtcaaaagaaaaaacaaacacgaccaagtaagccggaataaacaagtataaccacctgattgaattgccttctttaaacaagcacagacctccaaaaagaaaaggcttttgaaacgctgctcacgcacagttgttt

SEQ ID NO: 14815 - DNA, 484 bp, Saccharomyces cerevisiae
agataactagaaatacactcttatctttagatttaggttaaatatgaaataattaccaatgataactatatgtatctatatacatgcaaccccatcgcaacatactgtttgtcatcagtcatgaccttgagccttagcgagcatggtatgttcttcgatatcttcagcgtcccatggatagcacaaccacttatcagggacagtttgcgcagcaatgtaacgtccagaattcatcatggagtcaggtagtccagctctctttggtttgtccttattatgtagaacaaagatagaaataacggtttcctcactcattctattcaaaaccttttgttgttcagcaatctctttttccagctcagaaacagcatagtggagggtagttctagtatcgtcaacttcatccacaattaggacctttttaccaattaaggaatcgaaatgttggttcaaagcaccgaagtccagccattgtgttctgatg

SEQ ID NO: 14816 - DNA, 400 bp, Saccharomyces cerevisiae
gaacttcgttaaaaacattcaaaaaaaatttatagtttttcatatctcttaatgtagcatcatacatatcaatatgttaccatgtttcagacctttattgctgtactacattgaaatacctaggattcgaagaacaaaaaacatcatataggtcttccattagtaatgcccattatttacttaaagtaaaaaaaataatggtctctagcgggatcgaaccgctgatccccgcgttattagcacggtgccttaaccaactgggccaagagaccatgaaaaggacgtcaaaacaaggtcacacgaaaaccataacctgtagtataaatataagacatctcaagcacttgttattaattagggaaatagctaacagcatttgaacgataactaaggcaaacaa

SEQ ID NO: 14817 - DNA, 470 bp, Saccharomyces cerevisiae
tttcacgctaaaccgtagtgctgaataatagtgtattttaagattcgatgtgctagtcaataatgataaataatacacaagatttatgactttatatatataattctctgatacagttaataaaagacattggtacatgatatcaaacagaattttaacatttcttgatccagtttgtaaacaaaacaaacaatttttctaccatttaacttcataccatcggcgagagccgaacaggaaaaaaaagaagtctccggttatcgtaagcagtatcaaataataagaatgtatgtgtgtgcaatttgttatacccacgaagaagtgcgcagtagagttagaaaaccaactgagtaatctttactcccgacaatcgtccaataatcctcttgttgctaggaacgtgatgatggatttcgtttgaaatccggacggaaaactcaaaagaagtccaaccaccaaccattttcgag

SEQ ID NO: 14818 - DNA, 418 bp, Saccharomyces cerevisiae
tgcagatgaatataaagataagtacgctaagattataaaaagtgcttgaagctcaaaaatatgtattcctttaatttctgcggtaccctatgccggagcactaagaaaaacacattcaaaaaaattttcatactcatctcatctctacaattaaacaatacataaaacaaatatcgtgacttagttattttacttatatcattcaataaacctaatcaatcaatggctaaattacagaggaagagaagcaaggctcttgggtcatctctagagatgtcccagataatggatgcaggaacaaacaaaattaaaagaagaataagagatttagagaggttattaaaaaagaagaaagatatacttccatccacagtaataatagaaaaggaaagaaatttgcaagctttacggttggaat

SEQ ID NO: 14819 - DNA, 415 bp, Saccharomyces cerevisiae
atatatgtaagcactctatttgtacgaatatatttacgtgtgtacgtgcatgcacgcaagtttaatctagttctacaaacctactgctgtattgagattgatctcttccccttcgttttggaccgctatcattgatgcgtccaaacccgtcctcgttcaactgctttctgaaaaatttagaacgtttaaccatcttcagcgtccttgtgtagcacatctctccccatgacagatatctatgtatccagccgcccaactgatactggttgtaaaagaatatcattcccgtctcccttcttattgccgataggagcatagctaccaacgtcccctctactacccaccttatcattcccaacatcttgcaatatgttacgatctgatcttcactctcttttgctccttctttttgctg

SEQ ID NO: 14820 - DNA, 407 bp, Saccharomyces cerevisiae
atcatatatcttgtactaaattttgcgttatgttagcaatcatatctatttcgtgaggaactttaagagagttgaacgatttcgaaaattatataacagtaaaccgtacttctttcatttttgtaccttgctttacatcattactttttataagatccatcgaacgtttgacgtgttttctatccataaaccggccaaaatataaaaatatccagctgacaagagaaagcttggagtgctcacatgttagcacatgtgagcacaatgatatatacgctttaaaaaagacttttctttattttacacatttatagacttaactattgaattcaagacaaaaaatcaaatcttgctgagttgttaagcgtctgacatttcaacatcttcgttgtcatcatcactttcca

SEQ ID NO: 14821 - DNA, 448 bp, Saccharomyces cerevisiae
acaaaaattgaaccaaaagctatagtagtcatatatatatatatacaccctttttattgttacaaaaagatttcaccatcagaaatctaaagaagccggttcatcatcatcttcacgttctcttttcactgaacccagttcatttttcaaaagagaactcacatatgcttggaactgattgataaaaggttgtaaagctgttaatgaaacatcattatttttctccatttctgtttgaagatcaattagcttaggtgctttttcaggtgcaaaggattcatcaataggcacacagacattccccgtagcaggatgaatacaaaaaggggcctttaacaaatgaattgtttgctttgtaacttccacatccagcttcggataaagagtcatcaatacgagatcttccttacattcacgtaacttaattatgtgagagtcttgcttgggg

SEQ ID NO: 14822 - DNA, 484 bp, Saccharomyces cerevisiae
gcttgttgtctacaaattataaaatagttttttataatcaaccattaaataattttgtacacttataataacactttatttctcgttccaattatgcgatgcatgtgccttccgtttagagtgagcattatcaaatataaagtcaaatccttttggcatttattttgattgaaacccagtctgtccttaactcttttgcctatcaaacgctgtaggtcactcttggtacggtacagcggatagcgctatttattcagcaagagaagcaagattaggcgactacaatagatcaaaattttacaagtaaaacaagtaggaacaatcacttatgcaaatgattaatgctgatatgtttatttacatcacagtgcccttatgatcaggaactgtttaaaaacttttttttttttttttttttttttttaaaatctaaatatgttgcttgaattataaatacaataacgggaaaacatatgatgtgtca

SEQ ID NO: 14823 - DNA, 423 bp, Saccharomyces cerevisiae
cagttgcaaaacctttcacgttataattgataacctgtgtctttactcaaagcgtataactatatttcggtttataaagaaaaattcatagctatgctcatgacagaatatcttttttgagatcttcaccacaaccatataaatcaactgaccctagtccgtaaactttctcataatgtagataactcaaattctggaagaagcttcttagttgcgtgtgtctctcgattttgtgaatgcctcgtaataatgggagaccatcttttaaagttgtcggtaattcaagatcatcagttttggttatttcgtaatctttgaattctgcgatttcatctaccagcgcgacgaatgagttcgttttatatacgcaatttattgtatcaataacaaagatccactcattcgtagaggtgaagccttcca

SEQ ID NO: 14824 - DNA, 419 bp, Saccharomyces cerevisiae
tacgatttcataattcgaaaaattctactgtgtatgtatatgtttaagagattaaataattcttcaaaatcatcaaacatcaagcttatttaataatcctcttaataaaaccacctagtgttatttcgaatttcttaaacaaaaaacacatacatatgatacatatctcaaagcattacggaattacctgttttgttattatttatgcttcttgtttaatcttgaagtcaacctcttgtacatctcactattgtttaaagtggaaccaacaccaactgctcttgcgtttgtaggtactgcgctaaggttactcacaggagcatacttgtaatcagtagtggtttgtgctggtgcggcagccctgtttctccttgcagcagcttgttcgtacaaggtttgtaccgaagaaccacgagagg

SEQ ID NO: 14825 - DNA, 494 bp, Saccharomyces cerevisiae
gatgtgtaattggtaaagatattgatatactattcttaaagaccaaaaaaaagctgttaataacccaagtttaaacattagtagataatgcaatatttgatgaagtctgtagagtgccactatacatcgtaataaaattacacagtacgtgcttgtacggtcgccatatcatgagattacttgaagcttccttgaagctcataccgtaaccagttttatacgtttttctttcctcataccaacatcctttaacgtttgttgagagaaaatgcggtagtttttgtaaaacaccttacgtgaaagatattattactatttcaagaccaaacgcgtaacgaatgtatattctagtactgcgttaaggtatgagttacccataataaattttattactattaacattttcttggagtacttcgttttcttacttgatgtacgttgctatacagtacgcattaaagaaattgcagctatcgtcgtgtttggttcatacg

SEQ ID NO: 14826 - DNA, 443 bp, Saccharomyces cerevisiae
aaccattttccgtcatttatggaattttatcgaaggtgttcattagaaaagaagacaaaacgaacataagttcacttggactttggaaggctaccgcccccaatttgtcaaaaaaaaaaatacatacaatttagtctatagagtctgttataataaattaattgtttttagacgagaaatgtgaactaaaactgtttagtatctatcaaattatccgttatagcatagtacggctatatatggtctgattgctggtctcatatgactttatggtttaaatttcataaagctggccattgcatggttcgcgctggaaagagaggaaaagcgtggtgataaagagcaaaccaagcatactgttatatgcgattacagactatctgaccaaaagacatatttcgccatttcttctcaatcatgtcttccagggcaattttgtaagc

SEQ ID NO: 14827 - DNA, 449 bp, Saccharomyces cerevisiae
gcaataaatgggtgcagtttactcgtataattggttttgcatttgaatccaatccagtaaagaggatttactatactctcttcataaagggtatgtacagatacatttataagttagttaaccggctttattgtcgtaatagtcatctcttgatgtcatgggttgctgtccgtgcgatttcaagactgctcatttcgcacgatgcatattgcttctctaatgacatttttcgttagaatgatcaggtttttgccatagcttgatcagtaaattaatagatgattttaacaattcaagaggcattaaaacttgggcaaaggagtaataatgtctaataccgaggaattgatccaaaactcaataggttttctccagaaaacttttaaagcactcccagtttcgtttgactccattcgacatgaaccacttccatcttcaatgttgcatgc

SEQ ID NO: 14828 - DNA, 442 bp, Saccharomyces cerevisiae
tggtaaatagaaacggaactttacatattgaataccggagatataattcgtttatgccacataatcatcaatacatccgtaacccgcccgaaacggaaaaactgaagaaaaattacataaaaagtttaatatttttatcaaatttaattgaacctatatttaggaacattattgtttttaatttctaaaccggttgggttggtcgatagttgtgctctggatcattgataaaccactgacgtgtaatagttttatttctttgaaaaattcaaaagaaataacaacactcgttctcggaaacaagaaaatacacacaataatgtctactattccctcagaaatcatcaattggaccatcttaaatgaaattatatctatggatgacgatgattccgatttttctaaaggtctaattattcaatttatcgaccaggcacaaaca

SEQ ID NO: 14829 - DNA, 421 bp, Saccharomyces cerevisiae
gcattcatctaggttctccacataatgtatagtttaacatatcatcaccattgtttagttaaatcgtttagagtaatattacccgtcaaaaaggtcgggtaaaattttattaccctctccgaaaagaaaatttttttcgtcgtcaatagagtttaatgcaatacctgataaagagagttttacattgcaagaggtagtgttaattctggatttatattgtacatatgtgtttgtgttagtgcttgagtacttcctaggagttttacgaaaaataaaagcatttttgtctgaaaactagtgaaaggaagaaaaatgtccgttgaagaagttagcaagaagtttgaagaaaacgtttcagtcgatgataccacagctactccaaagactgttttaagtgacagtgctcacttcgatgtcaagc

SEQ ID NO: 14830 - DNA, 408 bp, Saccharomyces cerevisiae
gcatgaattaagatcatcgtagtaagtacataagtaaaaaacaagaattaaataaaatttctatatcaaccagcagaagaagtggtctatataaaccactatataatgaatttcgataaacactctttaattgttaaccaggctgttctccttactcatctttgcgatccgatgctgttttattacccttctattttttcctttctgcattttgattttcgcgaataatgaaattcttgatctttttatcaacaatgaaaaaaaaactgtaaacagaaactgataatttcttgaaccctttagcccaccccaaccgtactcgtgttattcgctcgttgatttacgcgaacctttttgtttgctttacatagcctctagccattcaaagattcgctaccctgaaccatg

SEQ ID NO: 14831 - DNA, 478 bp, Saccharomyces cerevisiae
tgagcgcctaacgttacagtaacaaatatgtatgatagatattattcatatccgccagtaatatttactatatctttgaatgggtttgtttattaataatctactatgtgtaaatatatgatccaagtattatacagtttagacactgattgttttccagacgttcaaaccgtcagtaccggtacttactaaacaacctgggatttgcttatgccatttgacatctttaacttccttttgccagtgaacaaacaataattgtggtggaatttcttgtagctcttttgtttcggcggcctgttgtttaatttcctcatcgtcagcttctacagacaaatcccacaaagtcacagtattatcttctgagcctaccgcaacgatagactcatctaatgggttgaatgcaatggaagtaatggctcccttatggaagtcatattgagcaaccggttggacggcgtcagcattacttggcgta

SEQ ID NO: 14832 - DNA, 495 bp, Saccharomyces cerevisiae
caataagttcgcatagaaaataattttaatataggcgagaatttcaatttgtacctactggcgcaaattcaataggtgttatctattgaaagcactgaacttaaatttaccaatgtatacacgctcaacataaaaaagaggtaaaagaaaatatatttttttgtaaggaaaggcttaataaatatttacaagctagataaaaaaaaaatcaaatagcaagctattctgtcatatcttaaggtgctgattgtttgtaggcacgaagtaaacaagctcttccccaaaacaataaatacggttttcgggactgttcacccgtacattttacgtttccgacggcgcgatgctatctttgaatttttatctctttcaggtaaccccatgaccagtagggcggcttactaccgaagagaaaaatgtccgcggcctagacagttacttcccaggccagggccaggccacacggacagaggcagattccaagttgttccgcat

SEQ ID NO: 14833 - DNA, 406 bp, Saccharomyces cerevisiae
tgttcataagtaataaatgccgtatagaatatgataatagtcttcgcggctcttataattgaaccaatgtaggtttgtattacccggaaacgtatatcgctacacacgaatatacaactaatagctatatacaaatgctttcatctcagacttggcaggtatattttaccaagccgcttcacctcttatcctccacttcatgcatacttttcaatagagagcatttcttaccacctcaccttagtttcagctgtagcctcttttctgacataatattggtaagtcgggttaaccaattccgggccgaaagctttttttattcactctatttttgtttgcatttaaactcacagtggatattgaaggaaggaatcagccctgagattgtgtgacaagccttttgcaa

SEQ ID NO: 14834 - DNA, 419 bp, Saccharomyces cerevisiae
gtgtttgttgtttatgtatccgcatatagcagttataacagataaatggcacttttcgcacacccgttgttttatctccgatagtacgtgggcctttatttatggtcgtttaacgaaagaacggcatcttgaattgagcaggtatttaaaagataggacgagaaacaagcacatgatctgtgtcgaaaaaaagtagcaaagagaaaaagtaggaggataggatgaacaggaaagtagctatcgtaacgggtactaatagtaatcttggtctgaacattgtgttccgtctgattgaaactgaggacaccaatgtcagattgaccattgtggtgacttctagaacgcttcctcgagtgcaggaggtgattaaccagattaaagatttttacaacaaatcaggccgtgtagaggatttggaa

SEQ ID NO: 14835 - DNA, 482 bp, Saccharomyces cerevisiae
ctctaggtatgtaccctgtgtattttcgtaagctagtaacgtattatgccatttatgtcacaccgttcataatatttgcctattgcattggctgtgatagcggcggcgcaaagaaattaggaagtataaaaaaaaaaatacaaaacttaatctgaatggaataagatagcgataactctcaacaaatggaagcgagacagaagaaaaagaccaacgatgttcaagcatagtacaggtattctctcgaggacagtttctgcaagatcgcctacattggtcctgagaacatttacaacgaaggctccaaagatctatacttttgaccaggtcaggaacctagtcgaacaccccaatgataaaaaactattggtagatgtaagggaacccaaggaagtaaaggattacaagatgccaactacaataaatattccggtgaatagtgcccctggcgctcttggattgcccgaaaaggagtttcacaa

SEQ ID NO: 14836 - DNA, 495 bp, Saccharomyces cerevisiae
cattctcgccaccttggaataaccgtatgatgttcaactttgttatttatttccacattctggatcgccatctgttcgtttttattaaatataatatatacccatttgtatctcctgtttggtttccaaatttccatatacttatcgctgtctatcatctcctctcgaagcatttttttatatactatattatgagaaatctttctgaaaaattatgaattacttttttctgctgatagtacaacccgctatatactgttacaagtagtgaataaagaagtaaaaaaaaaaaaactttcaaaggaaagaatatgaagtgaacatttttttctacgattaagatccccctgtttcttttttctttttgaaccatcttgtcagcttacgggaattttgttctttaggaacatctgcgttaggaggtttcctcattatcctagataactttgtcggggaaaatctattccccaagttacctttaccttgcgagtttgg

SEQ ID NO: 14837 - DNA, 458 bp, Saccharomyces cerevisiae
taggagactcttatacgtcggcgtctatacaaaaataacgctgctgtaatatttaagtatttatagatttttctatatatcgcataaatacttcaaggacattatatttttagtatcaacttattttctttagaatttttcattcattaaggatacggcactgtttttgaagcaacaaaatataaaaattgagccaacgacgagtacaatctgtaatcttccacgcctaccaatgcaaaacctttctgtcatgaagcactaagcatagcgcttcaatttgtggcaatcaccataataaacagcttgtttcttggaggatatgaaaaagattatcaatcattcgttaggtgaaaaaaaaccgcaacaatttcctacactccgaaaagtaaccttaaaatgcagcaaatttcaaatttaattttgattaagtaagtaatctcaactttcgctctccaacc

SEQ ID NO: 14838 - DNA, 440 bp, Saccharomyces cerevisiae
ttagctatatgtacgttgttagtgccgttaataataaattcatcctctatcatagaaacagggcatgagaaacgaagaaaaattgatattgtaacaatatcatgagaccttttatagaagtggcgccaaaactaaatgtatttgaaaatacaaaaaacgcacaggtttctttatatatgtatatatatatatatatatatataaaactgtacatatactgtttaaattaatctatttattcattggccagcttatataacgtctccttgaagtactttatcaaatgtgtgttctcctcatgggttccaacggtaattctcaaacatccggaacagcctaattcgttacctctaaatctgacgacaaccccagattgagtagccaattggtaatataacttctttgccaagacattgtcacccccgttgatccgtattaaa

SEQ ID NO: 14839 - DNA, 450 bp, Saccharomyces cerevisiae
atataagtgattagtatagtttttcattttagctcttagacgtatatatttcatctttataaaaatagatacatgtgtatacaaagcaaaaccaaaaaaaaaaaaaaaatttttcagccatctgttaagaaatgtgttttttcaataagatagcatcttgttcgtcgccatttacaccttttatgaaattgttgacagtttcgcccacttgttcgaagccatgagctataaaccattgctttgtaagatcatccactgctggtaaatagacaaacacgttatgttgatgacattctgagcatttgtcttctgcaaacttcagtaattttgaaccgatggatttgtgcctataattaggcaacacgcccaaaaattcgatttgaatgcccttgagagatagttcgttttgttttttaggaactaatttagcaaccaaaccacccactggta

SEQ ID NO: 14840 - DNA, 419 bp, Saccharomyces cerevisiae
gaaattgtggggattatttttcgctcttttcattttcttataattgtataccatcaataaacacaacagcctttaatttacgtaaaattatatcatggtttctatataaattacgctattacgcaattaatacgattgcctagcggtggaatgcgggccgttattcatgagacccatacatctcatagaaagcttgacacacgtcaaaattggccataaacgggtaaatgtcaacaaactaaatttcttgacgcgaaatcgagttgtttatgatgctaataatatgtagacaataatatcgtgtactgtgtttaaataaaatttatagggaagaaggagttcaaaacggtatccggggctagttgtggtattttcaagtgtgctaacgctattaaaagattgtttggactgcccgtatt

SEQ ID NO: 14841 - DNA, 480 bp, Saccharomyces cerevisiae
ctttgatatccattcattgacgtgaatattattctgaacactttctcttttacttctatatatatttatgttcgtatcaaaatcatgatattataaaacaaaattttcgaaccctttctctccgcgagatttgaatagtgatattttggactaaatcataaaaaaagaaagaaacgataatgttaatagccattcatactaattgaacacttgaattgttctgctctttatttcgaataaatatatatatatatatatatatacgtgatattactcttaatatataccagtatcttttaagcaggaataggagggagaggcgtctctctcgttgtagtttcttgattttccttattctgctttttcttatcttttctgtacactcttgtattccctggtgcaaacccaccattgccaaacaatgcccattcgggtgtcttttctaaatagtccatgtacgtgaagtctttgcccgagttt

SEQ ID NO: 14842 - DNA, 412 bp, Saccharomyces cerevisiae
gccgagatacataaggttgaagattactatttagactatctatctatacgtatacaccgcaatatacaaacagaaaaaaaaaaaaagaaaaagcattcgtaagaactcacagctccagagcacgaacatactggtacgccaaatcacatatttcgttgctggtgtccggccccaacgagtcggatgaggttttgtactccttggcccggatttcagctaggtgtccttcgatgcctgcaatcttggtctcaaactcgcccgcttcgtccgcctgcagttctatcaggagacccttgaacccagtggaggagaagaggttgacgagtcgcacggtgagcccgtccaagatcaacgtctcaccggcatcacccttgatgagctgcctctgcatccagatgttggacagcttgga

SEQ ID NO: 14843 - DNA, 401 bp, Saccharomyces cerevisiae
atgtgttgagtgttgttctataaatgcatgccatcttaagctctgctgtgctcttctcgttaaggaaaaaatgcgatggtatatatatagatatatatatatatatatgtatctgtatatatatgttcatacatatatatatatctattattgttgttattattatcgtgattattatttaggtcctcccttctttttacctgtttttaatctaccctcaaatccggctcttttctttggtacggcactaccgacatactttcttttcatcttttcttgcttatttctctttttacccttgttgtctttcctaatcctcagattctcttctcttctcttttgtctttcagatatcgtgtcttccacaaccctcttacgttcgctccattcaatcgcagact

SEQ ID NO: 14844 - DNA, 400 bp, Saccharomyces cerevisiae
aatttgtaactctatgtatgctttttatatagaaatggagaaagtgaacaattgaagttatagtattttcggagaaatgttgcatatatacataggaaaacggttaaaaggccctgcttctaccttctgtttccccctcgttcttttcaccagaacttgtaccatttcttctcagaggaggcctgagataaattctggttactttgttcaaactgactctgcttttcatttttggcggcctcccattgccccggcagagatgggtcatgagggacattatggagcattggtttttcctttttcgccacggtttcctttgccaattgtgcgatctggaaacttttttgtctctttagcctacattgctcccatccgacaatcgagcccagtatcagagagc

SEQ ID NO: 14845 - DNA, 452 bp, Saccharomyces cerevisiae
aactagggaggcaaaaatacaaaaaaaaaatgcggttccgcaatgatgaggcaacaatctatcatattttccacgtgagggagctcaaagttcggtatatagcttacatctcaatatcacaatcacttttttttttgacgtctttataaatatagaataacgtttacgttactgctattttttcgtttcttatctcagtttgcctgaggacggctatagttttaatcattaaacgtatattaagtacacatgaacatatataaatctcaggtttgtgcatgcttcgattttttttttctatgttaatgtcatggatcattacgtggctgggatagtggaaatatgcaaacatgattaaggcgcctagttccaacacggcgcaagctgcgagtatatgacttgttacctgcactttttaatagtcatcacaagggggaggatcgctttctaac

SEQ ID NO: 14846 - DNA, 431 bp, Saccharomyces cerevisiae
tagaatttcctatttttattcattccagttctagctacgaagtatacgatctgcttacgtcatatatttgtgtgtaattagaaggcattcaggaagtcgcttttaacttttcagggctatatgtcctaatccactactttttttgagaactttaagaaataactcctttgaacctgtctgtgccaaacaaaattttgctggtacattttatggtatataaacaagctacgttattattacttttttttgatagttttacttatactagaaaataatattatatcatcacaaaagaaactctctcgttaagaatcccgaatattcagcaggagcaaaaaaaaaataccataatttaaatgcttattcagtacttagctgctgattttatcgcaagtatactattggagagtaccgtggttcatatcgtgcta

SEQ ID NO: 14847 - DNA, 401 bp, Saccharomyces cerevisiae
cttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgc

SEQ ID NO: 14848 - DNA, 443 bp, Saccharomyces cerevisiae
acggcttgaaagtaaaacatagaacttaagtatattttagtatagtaaatcattgttcaacaaaatgtgataaaggaagtcaaaaactaaccgcaaaactatttacataatatattttcttatagcagagcttattatttgttcttgattctttttcttttttcttttttttatgctttgaagtgtgttagttgatttttgttcgttaattttcgtgttaatttatccatccattttagctattttatcacacagagcataatataacaaacacagctcagtaccacacatataacataacactaaaattaacatttctatagtcatccgtttgttggtctttaaagggctattactgaggcaaatatcaaggaactaagaataccacaaacgatacactgataatcaagaaacgtataagggaaaagagcacgatggcaagt

SEQ ID NO: 14849 - DNA, 464 bp, Saccharomyces cerevisiae
atcaacagataacaatcagtctttctttaatctttatctttattaaccgatcatcatgtatagattttgatatacaatacagatagaaataaaagtaaatcgtgaaagattttggcctttgcgtgtgagagttatgtacttcaaaaatgccattctgttcctacataaaaaataagtattttcaagtcatcggatcagtacgaaaaagaaaaatttgaagtacttaaaatacgaccagtttcatttaaacagcaatggaaaaatctcctctaatgaaaaaaaaagaaaaacattgaaattcagtataaaaatgtctgaatttaagatgtatgctttgacataagatacaagtttgcctctaatttcatttttttactaacttttcaacgaatcgtttaatattctaattattttgcagagtatcaagaaaagatctttataatgaaggagagggattaggagaa

SEQ ID NO: 14850 - DNA, 430 bp, Saccharomyces cerevisiae
aatagaaaacggaggaggttttttgtaatcattcccaccaccgtccagtgatcttcacattttgttctagtattatgattttgatgtacatttgatatttttttatgttttttatttaaaaagtaagggcgaaaatgtctattattaaaaaaatattaagtactttacgtgctttttaatatcgttttttattgattatgtatctttaatgggttattgattttttttgttttctttttatatagtatatacgcttgacgttccgcgcgattgtttgttatttatagtgtccttcttaattagatttttcgtcggcgttattgtgtactaaatacagagtatcaagatctttgatctcattagtgactcttaaggaagcgccaatattataaaatgaaacttgtttaccctctttcaatttgcatagttg

SEQ ID NO: 14851 - DNA, 450 bp, Saccharomyces cerevisiae
tcctgacgctttttatttcattttgttgtagcccgcccatacatgtatacgtatatatatatatatatttattggaagtaaaagtaaaaaactcgcttacctagcacatgtttaaacaagcgttgaaatgaaggaaataatgaaagtctagttttgtctagcgataaatagtgttaattaaaacagccttttacaactaaagaatatttatataataatgatgccatataccacacatgggaaaacaaatatataagggggaagtgggaggatgaaaaaagagtaatgaaaatactagtagtaccaggtgaggtaaaacaagcacgtccgtcccgctttcaccctggagaaatatatctaggaagatatgcatgagaagagggagagaaaggaaatgctagattaagggaaagaaatatgacaatattaatgagaaacatccatgcttgc

SEQ ID NO: 14852 - DNA, 475 bp, Saccharomyces cerevisiae
gtgcacactttcaagctaacacgcactttatttatatttaaatgacataaagttatatatctagaaagtttatttatcgttctcagtaccatcctcatcctagtatgtatagcttgtacccattaaaagaattttatcatgccgccgaaaggaacaatttcaagtactatcggaagatgaatggttagatgttaagcgctgtcacttcaaacttcacatttataaagatgtcacatggaccactattatctaccttaagttatttatcaagataagtttccggatctttttctttcctaacaccccagtcagcctgagttacatccagccattgaaccttagaaaatcttttgtcattagcggtttgagccctaagatcaacatcttgcttagtaatcactgcaatggcgtcataaccaccagcaccaggtattaagcaagtaagaactccttttaaggtctggcaatcatccaa

SEQ ID NO: 14853 - DNA, 483 bp, Saccharomyces cerevisiae
ttgcaaaactagagtgttactgtgactgtacaaagaaaataaataaataagtgaataaataatggtacgaataacacagtaaaaagggcacccgtttttagtgtatggaaaaagttgagtgctttaccctttttccatgatgaccgttgaaacatgtacggactatcaagtaatagtgagggtaaagacagtatatacacacttccttttattttcgtctcatcttgtattttcatttgaaggacggaatatttacttttcatggcttgtatttttactcgattccaactttttttcaagcttatcaaattcctttaatgctatttcttgctcaggatccatgatctgaatcacttctttcacttcatccacatagtgcttcaacatggactcaataccgtacttcaaagtcacttcactagaagagcatgaggtacatgcaccttgtaatcttaaataaacggttccagtctttggatccca

SEQ ID NO: 14854 - DNA, 470 bp, Saccharomyces cerevisiae
gtgtaagtttattatgtatttcgagcatgcatctggaacctatgtttacatacgtacaaacggtatttaaaagtttctattcttagcgtcaattgccctttatcgttttgttaaccaattgttgtttttattcattatgccatgacccgaaaaatgagcaaaatcggtcaaagtaaatagctaaatatttggtctaaaaagtaagagagaaatgaaaatggcaaggcttaactactttgcaatagtgtatatagacattaccaattgagtccagcaacgaaagattccgcttgcacttggtcaatcatttactgaccataatacgaagtaatagagatgctactaaaagatgaccatgcgattacaatttacaatagacaattaagcgcaaggacaatcagtatgcattccatttctaatagacaaggtgctatgagtgaattgctagcctcccctttttattttgtgcg

SEQ ID NO: 14855 - DNA, 465 bp, Saccharomyces cerevisiae
agcagtggcaaattgcatatataagtgtacagtggaagcaagtacgtaaataaataagcgatttcgaataataataacaacaagcataaggcagtattacccgcgttgtcatttatggatgcgaaaaaagatgaagtaattcaagtgctattgtgatttaccatgccaatcaaacgtgcaacaaagatgagtatgaggggggacccaggcatagtacacagaaaagctttgtagactgtctttgttttcttaatttttcaagtaggctttctgcttttcttctgtacttatcgtatgctgggccgggcactaatcaacaagtatggatttttaattcatcctaggagatttgtacatttaaacgataagtcccttgatggaacatttatactaccttcgaagaaaaatcatatgtatgatgttccaactaatgatccaagcggtatcctgaatgcctcggatatc

SEQ ID NO: 14856 - DNA, 491 bp, Saccharomyces cerevisiae
tatgaagaataaagacatctagtctttaaatacttgaacaataaatacgaaatccttatataagcatcttttactaccaaaaaaatttaaaattaagcaagagaaaaaaacgagcaattgttaaaagaaactaaaatcatgtagatttcataaatcgtcatattctttgtctatataaatatttatcgtcacgaataaatcccgtgaatttctaacaaagtttatacaatatcacagttgtaaaagtaagaaaaaaaaagatcatagaaaacatgttcacataagtagaaaaagggcaccttcttgttgttcaaacttaatttacaaattaagtttaagcaccgatgataccaacggacttaccttcagcaattcttttttgggccaaagcagcaataacagcggcaccagcaccggaaccatcttcagcaggaacaatcttgattgggtagtcgtctagtgaggtttgagtccagccgtaaatgtccttc

SEQ ID NO: 14857 - DNA, 434 bp, Saccharomyces cerevisiae
gtggcttaaataagaagaaatgtatcaaaaggtttatcatacgtaacagtaacggcactttataaatctttctttagtattacttatactttcataaggaaacgtaaaaaaaaaaaaaccggaaagagggacaaaatggactagaacgtaattgagagtgtagttcctgaagcttgaaccgctagtaagtcgtctacctttagtctaaaaagtattggctattgcattttatagtcttgcttctgatcagaacgtattaaatgagctcgtaaagactcttaggagtttttcacttttagagattaatactattaggaaaggtgcaaaaaaataaaacgccaactaactattagacgctaggccctaataccaactaccagtataactaagatttcacgcatatgatgagtcaagtatcgcattcccaagaagga

SEQ ID NO: 14858 - DNA, 436 bp, Saccharomyces cerevisiae
ttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgatatcgacaaaggaaaaggggcctgtttactcacaggcttttttcaagtaggtaattaagtcgtttctgtctttttccttcttcaacccaccaaaggccatcttggtaccaggaatatatttctttgggttagtcaagtactctgacatgttattttcgtcccacaacacgtttttcttgatattggcatctgtgtacgaatacccttcagcttgaccagagtgtctgcca

SEQ ID NO: 14859 - DNA, 408 bp, Saccharomyces cerevisiae
acatatattgctcaaaacgcacaaaaataaacatatgtatatatagacatacacacacacatatatatatatatattattattattatttacatatacgtacacacaattccatatcgagttaatatatacaattctggccttcttacctaaaaagatgatagctaaaagaaccactttttttatgcatttttttcttcgggaaggaaattaagggggagcggagcacctcttggccaatttgttttttttttatgtaataaagggctaacgatcgaagatcaatcacgaatattggacggttttaaaggagggcctctgagaagacagcatcaattcgtattttcgataattaacttgccttatagtgtctgattaggaaacaatcacgagacgataacgacggaat

SEQ ID NO: 14860 - DNA, 480 bp, Saccharomyces cerevisiae
aactaggatcaaggatgcatagatttatatagatacgccccttttcttgtgctggcattcaccatttgtgccattatatagacttttttttcgatatatatggaaaaagaacccagaaaataaagaatgtgaacaaaatagtatgtaaagtaaaaacatacaatctcggaagattaaaagagaagtgatatagacaagatggaagagactgcgaagaaaccagctagtgccacagtaagtgcgaagtcgtcgcacgatggtggcaccgacgatttggcgcacctttttagcacgccagagatcaagaaggtgctaaattccgatgtggcaattaacgctttgttgagccgtttaaagcagtcgttgttgacttgtgaagagtttatgaaatttattagaaagaaatacgccttcgaagaagagcacgttcaggagctctccaagcaatataagcactttttcaacattcagggttccaca

SEQ ID NO: 14861 - DNA, 424 bp, Saccharomyces cerevisiae
cttgattaatataggtgaaacataagtaaatttttctactatttctaatcaataaaaaataaccattacaatagttttctattaaatatgttaatgtttcaagtatgttcaacatcaaatattactatcgtcaccttccacgaatataatttgatacgaagtataatttttttgatttttttttcgcctccctttcttccctttaatgagatattgaaaaaaactgtctgaagttaattattaactatgagcggaatgctatctgtatatattgcattgggttagacaataatcgttttactcagatttatatcagataggaaaacgaccagtaactatttctattccggcacggcataaacgttttttttttgagacaattggcatatactccccccgcgcacgtcaatagatccttaactaa

SEQ ID NO: 14862 - DNA, 447 bp, Saccharomyces cerevisiae
tttcttttattgagacttatttttaatatatatagtacatgaaataataaaaaaccgaaaaatgcatacataaggttctattatattcccaatagaatgatcgttattttattttttgaaaggcatgaaaataatttcaaacaccgattgtttaaccaccgattgtttaaccaccgaaaccatataaggttctaccttgtctcttcaaagcataaacaacatccaaagaagtaacagtctttctcttggcgtgttcagtgtaagtaacagagtccctgatgacggattccaagaaggatttcaagacggctctgacttcttcgtagatcaaaccagaaatacgcttgacaccacctcttctagctaatcttctgatagctggcttagtgataccttgaatgttatctcttagaatctttctgtgacgcttggcaccaccttttccta

SEQ ID NO: 14863 - DNA, 430 bp, Saccharomyces cerevisiae
aattcacgctaaaaggaatacgtttacgtgtatactgtgattactactatatattatagtaaactaaactgatatttatgactactttttatatctgcaagtaattctttgtctcttgtatccttacataacttccagcgttgttccacaatatacgcttatttcattaaatctttctaatagaccccttgtaaaccaaccataatcattcaaatcatctcgttttatgtctattacccgttgtttgctcacgggacatatctttacatgcgttgtaagtattggaagcaaagtgacaccacacctcttccacgtgttattcgtggtggatgttacagtttcagggtcagccgtgaagctttctaaattgaacgtttcctcgagaaagctgttcttcatcaataacgtgccgttgtaaattggcgcttct

SEQ ID NO: 14864 - DNA, 481 bp, Saccharomyces cerevisiae
ttcccataaaatggaagttatcaatattgtaaagagaagcatttacaagcttttatttttctttttaatttccactactggttctgctttaaaatgttgttttataatttatgtacatttaggcctatagaagattctttcaataatatgctacacattcttttatttttccatcatatgttggagtttatgcctcctcggcaggagttgggcggtgcgaagagaagaaaaagagtgaaactaaaaaaaggaatctgcctttgcataagttcaaaagtgcaattttagtgttggatttaaacgggaaaaattgaaatggccatcgaaacaatacttgtaataaacaaatcaggcggactaatctatcagcggaattttaccaacgacgaacagaaattgaacagcaatgaatacttaattcttgctagtacactgcacggtgtattcgccatcgcgagccagctgactccgaaggcattac

SEQ ID NO: 14865 - DNA, 400 bp, Saccharomyces cerevisiae
aattcgttcttcggatagcttccgtgcgcaaccacattacttttgtaattttttatatttgcaatatgtaaaagatatatattttttaatgatacaggttcttttggagagaataggaaaatctctctatacctattcaaaattgataaaaagttttacaggttacactgagtcgccgttttaaccggtggtaatgtgcagacaatactttcattaattttcatctatatgtagctttctttccaaagcacctatgatctttttgtttttctttttgggaaccacttccaaggtttttccctttgatttaattttttttgtatttggtgaagagctgaatggattttcagaagtggcgctcaaatcgtttagaacctttcgtgcatccaaatgaaagtcg

SEQ ID NO: 14866 - DNA, 421 bp, Saccharomyces cerevisiae
gtttaagcatacatttatgtgcactgtaagtaattatatagaattttttttttttttttttttttcatatctgtcaatacttgaaaatgttctagttagagatttacgtatactgatcgcttgccttcgcaagggatggaaatcccttgaaaattaaaaaaatccccccctaagcagcgaaaattgtaagatccataatatttaagaaatgacgaagaacgtagtcttatcgcagcagttttccaaacaaagaatgccattcatcaaataatccacaaccacctcaagaaaaatggtgaaattacaaaggtttagcgaaaagaaaagcctcatacacgaattcggcaagtttatccttgaaaagcaagaatcggcgttaacgggcgacgctgatgcagtgttcaatatcgccatcagtgga

SEQ ID NO: 14867 - DNA, 430 bp, Saccharomyces cerevisiae
tttctttgaacaggtattttgagcattataacactttttcccccctcaactttgtattactcggtacacattgtaaaatgatctaattattagataagcttatgtatgctggatattatttactagaatacttgattggggttcccttttagtttgttagacaatccctcatacgaaagatctcctaacttttccaattgatcatttacatagtttttataagaaaactcgtcattattcaacagtacctcagggtcaaatatgataccctttccatgcaacctccatttgttagtccactcgatagccgttgatttttcattttggcttttattcacttgaagccttcttaaaacatcatatatatcatttgtgggagaattggtgcttccagggtaaagctctgttcttccatcgttcaaattttgca

SEQ ID NO: 14868 - DNA, 440 bp, Saccharomyces cerevisiae
ttgaacgtgtgatcttttccttcttctcagactctgtatatatacatatatgaataaagtagtgcgatatataacgctactaaataattcgaatgaaatagggaggaagtgaaaggtatgaatattgtatatgtcctatacgtctcttttatctctgactttaaaaaaatgatacgaaatccacaggatcaaaaatatcttcaatcacgtcaaactctgagacaattaaatcattaacaggcaaagcgggtgctaaaggttgttgtagtagttctttttgcggaatttcagctacttgttcattcgtaatgcttatgttggtatcaacttcagtatgtttagctaattgtgaactggcgtgatcataaaaggatgaaaaaatattaaacctgtcggaatatttctccatatccaagaattcttgcatttcctttatgcgc

SEQ ID NO: 14869 - DNA, 403 bp, Saccharomyces cerevisiae
tcttagtttggctttaacaatgtatagtttaaactcttatatttttcattatattcattatctacagtatgtaatattattgtaattgccttcttaatctcgaacgttaaattatgaaagtttatacacattatcggagttccagccttctttggaaagtaaccctcctactggtccctgattaagatcgtattttcttccagatatgctactaatataactttcggggccgcataccaatgccaacacaggcataatattcttgttgttaacgttggaaaaggggagcagacctttgtatgggtagggcttcgtgattgatttctggatacttttcaatacgtcttgtttagtttgtcggtctgtttcaaaaatttttaactggaccctgtttgaagcttga

SEQ ID NO: 14870 - DNA, 498 bp, Saccharomyces cerevisiae
tcataagcattataatctatttcgctattatattacaaatgctactgcactgtcattatagcctagtaaagtatatagtgaatacaatatactcagtttcaacattatgatgggtaactccatcagaaaatatattcatcgtcatatacggaacattcagttatacgcgaaagtaaaagtgagagcttttcaggggttaaaagctgggcgtgttccatgacgtatttaccgaggtcgtattatcaaagaaaatgaaaaaaaaaaaaaaaaaaaaaaaagcgaagaggaaaaagacaaacgaaaaacaaaacgaaataacgcattgtatgctggggcctcaattgaacttctttgactataaggagttcgcttgtttaaagccgtttcgcatctgactcgcccttggtttttttctctgttcttgtttttgacctccgcaaattcattgctctttgaattttgaagagtttcacttgtcaccgttgaataaccgagacg

SEQ ID NO: 14871 - DNA, 448 bp, Saccharomyces cerevisiae
agttttctgttgtgtggcagcaagagacagaacctcgataatttgacatacgtatataatagtacatgtacataaaaagctacgcaaatatcgtatatctgttatactacaaaacaattacttctatatcatagccagttagcgggaacgacttcagctaaatggactatccatgctttaggcagaggcgaagcgcggtgattgggtgtaacatcatctccttttctctacgacaaattcccaaaaaaaaaatttatgctatgttaatacctgcacaattcaaccgtgctgaaacgtaaaattaaggtgattatacggatagtatacgatattatcaatctcataagaaaaatctcttttgaatttaacggagggattattcattagaaagcgttcttaccattcactaggagcgaatccgtggaaggtgttttaacgttgccacgaa

SEQ ID NO: 14872 - DNA, 413 bp, Saccharomyces cerevisiae
taaggagggcaatttattgagtgcctttccttttgcatcccttatcccttctcccccttacgtaatagtttagatttttttatttttaattaagctcctttagggctaccgaacataaacaaatttaggtaatgagttttcatattcaagctctatcttagaataataatacttacattatacaatatgttctaatatcttttagcttaattttcttcttcctttttgacttcctctctcaaaacatcaggcttcaaagttgggaacaataagacttctctaatggtgttggagtcggtcaagaacatggccagtctatcaataccacaaccccaaccaccagttggtggtaaaccgtattctagagcattacagaaggtttcatcgactaattgagcttcgtcatcaccttg

SEQ ID NO: 14873 - DNA, 468 bp, Saccharomyces cerevisiae
ttatatgtgtacttgaaattccatgcgaaactaaatagaatataatgagaatataagtcttggaataaaaaaggaatataaaactatgctaaaaaaaaaaaaaaatgaataagactttcattcatgaagactctatacaaaggaatgaaaagttgtattaagttgggttagcccactgtaaaacgtaaattgcacctgagacaacaataatacttacaggcaaacttaagacagcgtacccccaaaatagaatatcggccatttctgcctcgaaaaattcattcagttgagtgatttgagttaattgaatggcaggaggggaaacagtcaaaagaaaaccgacaacaaggaaaattggatcgtccaaaatactcacgtttatgtacttaacagcaatagcaataataggcaaaaggaagcaagaaggtaaaatcattcttccgatgatggagccgatcaataacttgc

SEQ ID NO: 14874 - DNA, 410 bp, Saccharomyces cerevisiae
ctcttttcctaatattgcgagttcaatttaaccgctattatacttggttaaataatttatatacatccgtaagacgcgatagaaaattaaaaaccttggtgccaaatagttggggtgatgagactcattgattatgcaagttcataatagatagacaaacttgagctaaaagtactctactattgccagcatggacactttagagccaacagccgttgatacgcatgtttctgcggagcagattctgcgggatgtgtacaagaaggggcaaaaagcaagaggatcgactaatattgatatattagacttggaggaacttcgagagtatcaacgaaggaagagaacagaatatgagggttatttgaagagaaaccgactggatatgggacaatggattcgttatgcgcaat

SEQ ID NO: 14875 - DNA, 455 bp, Saccharomyces cerevisiae
tcgacgaggggcatacttactctacttaaattcatttacattagctctgtacttctgataatgaaaaaccattgcgtaatatacatattttcgtgtagaattatttccataaaatattcaccgccttttctgtactggccgccggcatgcgagggaagcagaaaattttcaattttgcgatgagctcttgaagaaacagtgttttgttatgaataaatgatgtgtgcacgaaagacccaaggaaagtcgtataatgtcagaactctttggagtattgaaatctaatgctggcagaattattttgaaggacccctccgccacttctaaagatgttaaagcatatatagattcagttatcaatacctgtaagaatgggagtattacaaagaaagcagaactggacgaaatcactgttgatggtttagacgccaatcaagtttggtggcaggtcaaac

SEQ ID NO: 14876 - DNA, 470 bp, Saccharomyces cerevisiae
accaaaccaacacacgtcgtcaaatatcatatacataatatatacacttaaaacagattcgtgttaatgaacttgttttgcactttcactgtacaatgcatgggctctctcataatatttctacgccgtcgcatcttaaccagccgcaaagagagagtatattccataattcagtttttcgcctttccttgcccttctgaaatgttgttaatatcatcataccctaatgaagagtgaaaattcacttaacccaagtgaaaaatacaacttcgaagagtgcaacgtgttgaaagaacccttcaaaaatagaaaagaggaaacgaaaaaaagaaaaagtagcatgctgtggaaaaattatgttctatccagttcccgaataacacgtaggcttcataagtcacctagaaagagcagcttctctaagaacttttttatcacaggctgcctactgacagttggagcagtaagca

SEQ ID NO: 14877 - DNA, 444 bp, Saccharomyces cerevisiae
tacaacgcctaatctcaagtagtatataacacttacttatatatatatatgtatatttttgcagaaaaataagagcaatgaacaagctgatatgatcatcgtgttagacttttgtaaagatcgtttatattatattgaagaccggactgtgaaaggtaaaatttcagtctatccaagaatgtgattccgttccaggttttagcaattggatcgtacctcggtattccgaattgttcaattattgcgcctgcagcgatgttcccacatatactagcaatatctaagcttttcgttagggcataagaaactgcaaagccgccaaggaacgagtttcccccgccagtaggatctagtactttagactgagttttgaaatggtaggcggggaaatggtcataggttcgtccgttcttaaacttctcacttaccgatatgcttccgagg

SEQ ID NO: 14878 - DNA, 465 bp, Saccharomyces cerevisiae
tgaaagtattgtctgcacattaccaccggttaaaacggcgactcagtgtaacctgtaaaactttttatcaattttgaataggtatagagagattttcctattctctccaaaagaacctgtatcattaaaaaatatatatcttttacatattgcaaatataaaaaattacaaaagtaatgtggttgcgcacggaagctatccgaagaacgaatttcaccttttctttttctctttaacctcttcatcagttgtggcatgtagcctaatgacgtttggatagtcgggtctgttgcccatatggccttgatgccaatcataacttagagcgtacgcaaatacgctaccattcctattgaagctgcatacaggaatagatgcttgcaaagtaggatagcctttcaatctatgcctttgattcttatcccaaaaattgaaggtaccatcaccaccagccgtaacaaaagt

SEQ ID NO: 14879 - DNA, 461 bp, Saccharomyces cerevisiae
ctctcctaatacttttacagcaatcatataaaacacataatgtctagatagcaaataatctttaaaattctttctgccctattgaaaattatgacaaactatcacggtcattttctgtctaactcggcaagaaattatcatcgtgaaatgaaaaaggttacatacaataaggttattttgagtacagactgataaatagatggaaaagactaaaaaactgaaacgataagcgtctagtaccttttccattagacgattcaatactgcattttgcaatggacaaagcatttgacgaaattattggaaatagtcacacagacagctcatctaatcataaggtaacgagataccgcagaagggatttaagaaatgaattaggacctagactgggatttgcgccttcggatgctgcatcaaggtcgaaagatcgcctttatagagagagggaagagcctcctttg

SEQ ID NO: 14880 - DNA, 437 bp, Saccharomyces cerevisiae
gtaaattggcactcaggcacatatctgcaacaagatgcatggagtacgtatgtggcaaacttttttttatagttgaaaatatatccatatgaggatgccagccatcatgtcaagtttcaatgtaattatggttgtgtatattatgtttgcagcaaaataaaataaaagggctctaactacaatatattaatataaagaaatgttattcaatctagtttgggtatgaattttttccctcttaataaaaatagtttaagtagtttgttcagtcttcttatcgctggtaaacattttttgggaatttggttttaaactatcaaaaaaatcctgaaaaaagtcttcaaaggaattgaattggtcgacgtcaggaatcatgaagtgactactggacaagttctcgtgcaaagtaccaacattagtaggcgaagtagcgggtt

SEQ ID NO: 14881 - DNA, 421 bp, Saccharomyces cerevisiae
tttgcgagacaagcgaagagaggatgtacactattgatgtatgaccattatgtatacaataaacttaatataatatgatataatataatataatatataacactaacactttcctgaggattttcggtatggcgccgagcgaaattttaaagagaacaacagaaacagtcaccaagacttcttcaattaggcagcgcaaaacggacacaacagcagtaaagacaaccggaatggactcgattataccggcaggcgtcaagctagatgatttacaagtgatattggctaagaacgagaatgaaaccagggacaaagtgtgtaagcagatcaacgaagcacgcgatgaaattctgccgttgcgattgcagttcaatgaattcatacagataatggcaaacatagaccaagaaggatccaagca

SEQ ID NO: 14882 - DNA, 422 bp, Saccharomyces cerevisiae
gcctcatgaaaatcaaagttagctagaagtatgtaaaggttgatgatgcaccgtaattgagcacatgtatcactattaacggcgtacgtattttggcgttttttcatgttgatgttattttgtatatagaaagtgaaattctcgaggatatggccctactggataatactattggtagcgtgaaagaaggccaggatgatagatatcaacgttaataacatattttttagatcttattcagttgatcctaactctggtcacgcaatttatgtctttgattcgacttatttgccagcatctgatgaaattggcgataagcaagtttatgacttgcttattaatgccctcatggatcgattggtaatgaaattgccacaggcaccatattcactggtgattttttcatctgggttttcccagag

SEQ ID NO: 14883 - DNA, 462 bp, Saccharomyces cerevisiae
ataatatttatccagagaaagcgccattctttttatatgtttatatcagaaacaaatagaagtcgatcgtaatgactagattatataatcagaaatagcctttggtgatcacttccattttagtcagcataatagaaagtttaattacgcgcttttttacattccgacaaagatctgcccgagaaaattcttcgagaagacaacaacaacaaaaaaaataaagcctgggcgaaaaacatcgtgcgtttacataatatcttgaaaagcaaacagatatataaaccgctattgaaattacctttttaagtattcgcctagaagccttgtttcaagtagcatcaacaacaggtgttaggttaaactgctttgactttttgttctttaacgaatatcattaaaaaaaaaggacatctataaagaatgtctccaaactcgtcgaaaactcgaacggaccagataagc

SEQ ID NO: 14884 - DNA, 451 bp, Saccharomyces cerevisiae
atgcaatgtatccggttgcccatgcattatttgtgatgttttcggatgtagttcgctgcgctccgcggcgatatatcctctagcgagaggcatatgtataaatatatatatatatatctaacaaaagcattcaagtttctttctctggtgttacgtctttgttcgactttctctgcttacagccctgtatgaccaaagaaaaaataaaaagacagctacataccagcagaaattttttatagtattacactatacatccaagttttttcacaattatttattgtttttctcacatagaaaattccgcatactgcgattataatgaactctacaaccccatcgattcaagatcaatatattttggccagcaaagtacgctccaagctggcaaaatgcgttagcgtgactactaaaaacaaagactacaacctgagagttttagtcgggcacg

SEQ ID NO: 14885 - DNA, 495 bp, Saccharomyces cerevisiae
gaaaatgcgtttttcagtttcattataacatgtatatttgcatttctttctcacggcaaagttagtgacaaagaataaggtttgtatgaagccaacgagatactttttctcttattgaaaattcttttggcctctgttttgttagtctggatactgaaaaaaatgtttaagattattaaatcacacaggaatgaaattgttattagaaaaattataatatacattctatatagggaaaaatttcttctgactttgaaatttagatgctaatagttttttttattatttctattttttttttttttaagatcagttgtttgctgctggcacctccactgattcgtaattgctagccgttattgagttctcaaaatgttcctcctcagagcttttgttaatgatgaaaaatgagcctaagatgagggtagcaccaaataaatagagcgcagacatggttttgtgcttaaagattacatcaccaaacattgctagggg

SEQ ID NO: 14886 - DNA, 419 bp, Saccharomyces cerevisiae
acattgtttataatatctttctggcctccttgtctatacataaaaattgaagaaaggcagcatgtagtacacagcacatgcatatatgtatgtatatatgtataaaaaatatgaccaagaagaaacaactgaaaagctttaagttgcgaggcttctgcatcaacaaaaaaaaaaaaaaaagggggggcgttaataaaatgtataatgtcaatttttatcttcatttttaatgtccgcagtggcgacagtctcgtccctgcactgctttaagaagggcattaatcttgtaccaccggttccgatagtcttagatgaggcaactttatgccctaaacaaccacttgctttggtattgggctcgattggacttagtacgttcggcttattggagccgtgttgctttgaattggagggcaaaa

SEQ ID NO: 14887 - DNA, 477 bp, Saccharomyces cerevisiae
gaaaatgttgccgattttgtttttgccactcctgtacattgtttaatctcagatcgttgtatatatatacatatatatagtgttttaacgacattcttatatttgcatttctgcttcttattacacctaactattctgtaactgccatgggtaagcatttttgaagtattaattaacaattaaactttcaaacatacccaccctttcgttggaataaaaatcaattaacacccactgactagtaaatattactagaataactgatgattatgccaattttctgacagttgttgggtttccattgttgacgaaggtcctattattagatatacggaacatactagatctctcgagcctatcggaacctactaagcggaatcggcaatatacatgttattcatttttttcgtttttcgttttacattattaattttacgtctcaacttggttcaatttcagagacagcatctcatcaca

SEQ ID NO: 14888 - DNA, 479 bp, Saccharomyces cerevisiae
caaaaagatatatacaaacataggatactaagaggaaaagcatcccaaaaagaagaaatgcttgcatgccatgtattacataattaaagaaaaattttattaacatacttccttatacttacaatatgtattctttcagttcaatttatttatacccgatgtcattagtctcttcgacaaacaatgcagcagactgatggagtactttgccaataaggtcaatttgttcttgagccctcttccagtcatcatcgtaaatcgcatccatcactcctggaaatgtccagaaatctacatttccaccatttttagatttatcctcctgtatcaatgttggtccgaacaaaacgttcttataaaatgatctattaggtagacccgccggagagcatgttcttctaccaatattagtcaattttttattccatgtccacctattaattgaaagtaaggagggctctataccatccccatgcgac

SEQ ID NO: 14889 - DNA, 469 bp, Saccharomyces cerevisiae
aaggactttataacgaaaaagcgtgaagaattaaatacttttaaaaatcgttatacggtacatatacatacacacacacacatatatatagtcgtctataatgtttttatacaatgtttatcataaattttgttacagtaagaagtataggagataatataaaaaaagaggaaaagcgaaaacaggtgataataatgatgatcataataataatataatagcaatagtcttgcaaaacaacaacttgaggaaggaaaatagtaataatggtgtttagctttttttagattactccagcttctaaaaaagagtacaatacttagcacaataatgctgttatcttttttcatttaattaaaaagaccagttgttaagaaataataaaaaaaaactcctttgtttagaattcaacaaattagaagaaaaagaacctagttattgttctaaaacctttgcccactgaactttt

SEQ ID NO: 14890 - DNA, 436 bp, Saccharomyces cerevisiae
tttccagctgcataatctgtagacatattttaagtatattttttaggcagttttataaattaacagactataattattttagagaaaaagacccagatttatacttctgacttttcttttttatgttgatcttattgtcactgtcattggatcataataatgattcttttttgaacttctcttgaaagtatcctcttattctcttttgatgataggtccaaatgcacgtgtacttagagattagagcgcagatggttttcttgtcaacatcatatcaattgtttgccgaaccaaaatacaacgttgacttgatcgttcctaggtccatcagctactgcacattcttacgagttattcatccgtgaaatatagctacattttcgagcatatcttgaagtggtccattctcaacatcaccctttcaattacgcgtgtt

SEQ ID NO: 14891 - DNA, 406 bp, Saccharomyces cerevisiae
cctacatttcctctgatgactgtgatcctttcttccgatgataatgcgccatttcagagcaagataggcaaaaataagcaaacaaggcttgctgtcatgcaatgtgtacgttagtccaccataaccaagcatgtatgaattatatatgtatacagtttacataaacttcaaactacaataagatgtgtggtccatcgtcgtgtgtagcgataggcgtcttctaaaagccgcaaaagtgacaagaagaaaaaaggaaaattattgagttataaaagctattgtttacatgatgagacgggataaatttaggacagatagctgtaaacactccgttttgaatcatatttgtgaaatatttggtctaaattttaagtcaagtttattttcttcgagcatttcaacacca

SEQ ID NO: 14892 - DNA, 419 bp, Saccharomyces cerevisiae
gccttatatatgaataattccaactgaaagaatccaataacagtgttctactttctgtttctattactattattattttaattggttatttactatataatttgcaagtgaagatgatcatgctggcaaaccaaagaataaaattgggttgacatccaatcgagaatatgacatatcattttgttttatttaagcaataaaaaataaatgacttttaatttacttttcaattttctttttttttttttcacttctgagatgtgcaagcgtgtagtttgtttgtatttgtataacaatttcatcattagtcattcttcattaaaaactttttgttatcgattaaggacatccagtatgattctttttctctcatcttgattatctcttgagagtattgttaggcaacgcattataccaca

SEQ ID NO: 14893 - DNA, 488 bp, Saccharomyces cerevisiae
attgagttgcatagatgttagccataatagaaaatagcgtatgaggtagcaggagttataagacgtatttacgtatatgtatgtatatgttattattattacctgtgattgcacgaaggcctttttttttcacaacaagaagatgtaagaaatttacatgctattttgattaatggtcgaattaggtattgtctttaatctttcattaagaaaatataatgtaaccaagaacagcttgttaaagggcttcctatttaaagttatcttcttttccccaaggtaccactcctatatggttgataagaattgtagtttctgtaattggaagagttggaaatgctgttattatcaacataagtagaagggttatatctggagccatacatattctccgatatcgacgagacgtttacttttgtattttgataccgtgaatttttactaatattattattgagtgacagcgtctcgccccttatagttggttg

SEQ ID NO: 14894 - DNA, 461 bp, Saccharomyces cerevisiae
tcccatatataataatagaaacaatataatgctgataatcttatttttctttgcgatgcggcagtgcctcttcccctccgtacggattgggaagattttcatttttgattagcaagggcactaagccaactctgtgtgatatagctaataatctaaaagctgctggatccgttatcgtcaagataaagcggacttagcgatttacataggatcacactttctacacacatttgatttttaagcttcattttccactgcacttatttttcccaagcatcgtgtttttttgtacattataaaaaaaaatcctgaacttagctagatattatggctatctgggagcaactagaagtctcaaaggcgcacgttgcttatgcatgtgttggtgtcttttcatctatcttctctttagtgtcactttatgtcaaggagaagctttatattggtgagtccaccgtagc

SEQ ID NO: 14895 - DNA, 412 bp, Saccharomyces cerevisiae
atggccaaaaacgacagatgcgtgtggaagtcacagtcttgttgtcttattttccagttcctgtgggaacttactttcaaatgtttttcatacactttgacatattgcagtaaattatatatgtaattttatatacgcttttacctacacgaattattgtctaacttttttttttcttcattcctaacgaggaagagattcaagacactgcaactagaagtcgtccggatcaaacagatcaagatcaagatctagggcatcatcattattttcttccttttctttatctttggtattgtctgcctcatcaccaacttctttagcagtaccatcaaatataaacgagtctgtctttggtgtaccttctttcttggccatctgccctttttgttcttcactttgagatggcggt

SEQ ID NO: 14896 - DNA, 463 bp, Saccharomyces cerevisiae
tgaaggaagcacgtcagaaaaagcaatatatagtaataaattcatgcactttataaatatggtatataatcagtggtacttacttacccataaataatggaacttttaatttttatgggaaggatactggattttcatttttttcattttttttggaacagggtactgaaacttttctttttgaaaaaaaaataagaactgaagaatttcaatgaactggaaggctcatccattttttttttttttcttcagatagaacaggctttagcaaattttaagtaatcagtatttcaatcgccacaatctcaggctacattgaactctgtaggccaccgataaatattgcgggataatgagtaaacgaattcaacgagtttcctattttggtattctatattttttcatacacctaaacgatcgtaaacatttgttgtcaagatttacgtttcttcgaggtctgtga

SEQ ID NO: 14897 - DNA, 417 bp, Saccharomyces cerevisiae
tagcccaaatctataatgccactaccatacataatttttatataatcccttattttgtgaacaaatagccatcatgattctcttttaagatgataaaaccgtcgtttctttttctgacgcgccatcttttctttttctatctgtcttttttttttttcctttggtgtttcatccgaagaagaaacaaaagaaagaagaccaatactttctaaagggcaattgcaaggtagatataactagaattgcacaatagagattgcttgcatcagtggcatagttaacaatattttctcggcctcctttgacgtaaaatctaaaagacctagtgctttcaaaacccgcgcatactgaaaaaaaaaaaaataaagaagagtgtactgaactggtactataattcatcgaaactcatttattcca

SEQ ID NO: 14898 - DNA, 415 bp, Saccharomyces cerevisiae
cagcccaactgataacgaaataatttccttttcttcctcttatatatgtatttatatatatgtgttcactataaccatacatatattatacagaagtatagacacgatttttccatacgtaacaaataacatcacgatgcacgagcactgtttccaatggagaacaagcgaaaggcggtaaatgcgctatgctgattggtgtagagcgcgggccaatgagaaggccccactctcagagggtgaggtgcgattatcggggacatgtctccgtcgatcgggcccacgtcgtcgcacaatataaataccatttgagtttttaatattaatttttcacgacaacccactcaaaaaagtatatattcactgttagttatacggaacattgcaatacatctacaagtcaaaggagcccctc

SEQ ID NO: 14899 - DNA, 400 bp, Saccharomyces cerevisiae
gaattaaattagggagaatatacatatatatgcatatgtttgtttagctaaataattttattgagctttgcttgggaaatttcttcatattactacttataataaaatagaatatgaaaaaaactaaaaaattaataaagaaacaaaaagtaaaaaaaaggtgtatgtactgtaatatgaattaataaacacctgtccattttagaaaaacgctatgtcgaaattggtcatatcaacgtcaatatttcagtctcaagtagcagatttactcccatgtaacaatcatcaaaaatcgcagctgacatattccctaataaacgcgtacgatcttctccagcactttgacgaagtgctaacatttccctacgccagaaaggatgatctgctggagttccattcg

SEQ ID NO: 14900 - DNA, 477 bp, Saccharomyces cerevisiae
ccttttgattaggaaaagtccatttatagatgctatctcattgtatatacacgtatacagggtacgtactttttccatctactcccactaaaatcttttggcgcttaagttggggttccacgctagccccggttctgactcttttgtagccgtctcatcctgtttccaaatctttatgcttttgtctgcttctccagtgattaatcttaaacctgttttatcgaaagtgctacaaagaacactccgttcaccttccagagagcctaccatttctctcgtggccaacgattggtatttgtgaccagacttataatcataaaaggaaagcacaccattgtcaccgccagcgaataatacatcatcttgattaatgcttaaagtattgattatgcctgtcttttcagactcaaaattggtgagtaaagacccctctgctaatccccatgatctgatgtcatcagtacacgcagaagccac

SEQ ID NO: 14901 - DNA, 473 bp, Saccharomyces cerevisiae
cgtagagaaaataattaaatagtggcaatttatgtacagaaaagagtaaaagatccacaaaattatcaagacctggaagagaagcctagtaacaaactaacctgttcataaacagtgaacgttaagcctcctgaaataccgactttcataaacctaaagatggagcccttccagaatgtggccatgccttcttgaacaaatattctatacatgcaatttaaggtatttttatattcagttttggcattttgactcatcatccttgtttttacgacgtcaatgggctgagtcattgccacgagtgtaaaagatgtggctaaccccgttattactgaggatgccttgtcgtttcttgcttgtaacaaccgtttaaatgctgtgtatgcagtaaattgaatagaggtgttagctatctgcctaaatatggtggctgttgttccctggacgaacgcagcagggcctcttgtttgata

SEQ ID NO: 14902 - DNA, 458 bp, Saccharomyces cerevisiae
acacaggagaaacaattccataaataaactttgtaagataactaaattataggtcccttttccatgtagcttctcatcgcaagatgcatagggtagtaaacaaatatttcgctaaaaaggtgattctctagtcacgtggtgcctttttttcccatcgttctagatcgatgcggtatgaacgaagaaggagaccttcttttttttttttaaaaaaaaacaaaacttatcacagccgctattcaaaatgctcagattgatgaggacaaattcgtcaagaaagtaaggtctccctatttagaagcgttgaaaaaagctggttttaatatttagtgttagactagccatatttactctttccttttaagcgatagttagccccacgataaaacttagcagtttttaaagacaacagatattaaagttgcttttaacactatttgcgtaattcccttctgctt

SEQ ID NO: 14903 - DNA, 443 bp, Saccharomyces cerevisiae
caataaaacaacaccaaataatgtagatacacacatatatattaattatacattagtatccccttgacataccccactaccgtcttcatgtggaaaattttccgtatttgctttccccttctgttccctaattctatagggtaagcgattcatcccttgttcgccacatctaagagaacttaaagccggggctcacctctactacagagattgcttatggtgaacaatattaagtgattatataacacagtaatgtacaaatatattttagtcatgtaggtgatattgtgcacggcgaggttctctgattgtgaacccgtataaggaatataagcggagaaacacaatatttataagtaacgatgcaagaattttattctttttcaccaatagatgaaaacggaaatccattccccttcaactccctgcgtaacaaagtggtt

SEQ ID NO: 14904 - DNA, 496 bp, Saccharomyces cerevisiae
tttcgatgtgcttgttacttgcgtctagatttttttgttcctaatgtaattttcctttacagcgtgcatatatatttttatctactgtgaggaaaagttgctctttaattatataaaaaacgcttatgtagcattgtgaaatcacatatgaatagatatgtaagaaggattagagggttcaagtaattgttgcagtagtcaatgtagccaaatgtctaaccactttggtgcatggagattagctcaataatctcgtagtatgtttccgggtaatattctctgtcttatttaccatctttatgtttccgcccttttatttttgtttttctcgctactcctttataattactaatgagaatcgaatactatagaaatttttgacgtaataaaggagcagtaaatttggaatacattccttagctcgctagaaagctgaaggaaatttagctaaacagagagtatagttttgaaatgattttacgggagcagatcgact

SEQ ID NO: 14905 - DNA, 441 bp, Saccharomyces cerevisiae
caagatacatagaccatacaactacatattaatctaagataagtcttgtgctgagtttggtcactttgcgggatcacccgcataaagtcgtcggcattgcagtttaagatcaaatagaggcaatactacgctgtgagacgatatttctgatcgtgattaaactggtattccacatgttcagcatccattagccgttagagataattcatttacgttccttttttctcttgcgcttgagattgttagattgttaaattactactgctttgtttttccatccgattagtataatcaacagatgaaaaaatgaaaaaaagaaaacaaaatcaacataacttgcacaagattgagccatcggaaaataaagcccattgtaattcatataactaaacatcatatcaagtgcgattggtctgcaaaatcgtgcttaacattccgaga

SEQ ID NO: 14906 - DNA, 460 bp, Saccharomyces cerevisiae
gcgcatccacgcttcttttttatttttactcactccttctgttgccttaagtactctcaaaaattactatttttatctagttttatagaaaagctaaaagaaaggctatatttattagagcgcgtgttgaaatatagtcacaacttatttaatgagttaaacttttggtttccttttaggttttttggtgctcagcctcgtcatcacccaataaagagtttattatcaatggcttcagtgaaacaaaccaacaaaactctccgagagggcaatccagagcatagcacaatcttttacatccgcggaagcattcttgctccgtcatatttccttccggacttcgctcggactctttttccgcggaaagatatggtctccgtcggtcctctgtttcctattatatttgcgcacagtgacagtgcggcaattgatatgtcagggaccactggaaaacgacgtt

SEQ ID NO: 14907 - DNA, 452 bp, Saccharomyces cerevisiae
aggcattaaaagaggagcgaatttttttttaataaaaatcttaataatcattaaaagataaataatagtctatatatacgtatataaataaaaaatattcaaaaaataaaataaactattattttagcgtaaaggatggggaaagagaaaagaaaaaaattgatctatcgatttcaattcaattcaatttatttcttttcggataagaaagcaacacctggcaattccttaccttccaataattccaaagaagcaccaccaccagtagagacatgggagatcttgtcagtgacaccgtacttcttagcgacagtggcagtgtcaccaccaccaatgatgacggtgttaccagcagcagagctcttgacaacttcgtctaacaaagccttagtaccagcagcgaacttttcgaattcgaaaacacctggtggaccgttccagacaatggtctt

SEQ ID NO: 14908 - DNA, 405 bp, Saccharomyces cerevisiae
ttatctccctggaaggtatccagagggcaggatacgttcgaaacaacaactacgttatataaatatttatacatagtgggatagaatgaacaattatcaagtaaaccttgtattttttgttcccacgctctacgctctgtttcttggatatggtaatcaaagattaatacgtataaccgttattaattcagtccactagaaactattaaaagcgccctactgtatggaaaaacaatgaatgaggagactgaacggcgcaaaattgttagtttagttgctctttttggcggccggcgataatgttcttcacttggtattcttaccaggattgagcctgattttgttttgtcttattctttgcgatgtcttcattttctacaaaacctctaatttctccggcaatgg

SEQ ID NO: 14909 - DNA, 445 bp, Saccharomyces cerevisiae
tatttttatgaatttagaagtgaccccggtattcaaatgcaaattttttatattatgtgattaatctaatgcaataaatatagatgattgtgatttatgtattgatgttgttgccgttcggttcctgaatatatacttctttttttcataatacttcatgcacatgtagtatcattttttatcttcagtctctagagaagggaataacgatcttcttgcgggcctgggtaaatcttctcggtcggaaccaacgaaagtaaaatctccgtcttgctcttcatctccacttacttgctgatgattgcctctctcatcttcgaaactaaaatatgatggggtatccagtccgtccattagtagcatatgtgaagtgcttaggttactgttactactcatagacgacttacttaagatggggaagaaattttcgtcgcctgtactctca

SEQ ID NO: 14910 - DNA, 452 bp, Saccharomyces cerevisiae
taggtcaaactctatttttatacagcaatgagtaccttttcacatacacataaatatattaaatataataaatacaataaatataaaataacccttttcgaaactctttacttcctaaggcctctcattacttatcacctagcatcatgctcttcatacatgccatctactttcaaacgatatacggctaaccagaaaagtacggacaatcagggacgagcagggacatgacgccttccgcacagatcccagagaaaagcagggaaacaagaaaataagaaaacaagaaaaacagtagttacccttgtaagtgtcatccacaacagaaccaatactcttactcttccgctcattccccgcagaatgatagaactattctaaatccccttgccttgcttggccttgacttgggttgggacttggacctctagaaccgatgtgccttcaaacat

SEQ ID NO: 14911 - DNA, 488 bp, Saccharomyces cerevisiae
tagagaggtaaatacgttggaagaatatatataaggtgaaaaaaggacgtacgtatttttgtattgcttaaatttcgaagtattttttctttttgtaaaagactgcaagtggaagccaaaatataatattttgttttttcattaagagtacaactttatacaacaattataacttgatttgagagccaagttatgtaagatatttttctcccacaaagagaaatgcacacgataggaatttacaacgtgaacgatacttgaaacgaaatatgaaaatccgcaagagtgcactgaattagctggaatcctgtggttccaattgatccaaaacctcacagtttggatgaataacataaacagttttattattttcattttcctcattctcaagatctcttaaattgtgtctggtaccatgaatctccattaaaatcctatctttgaccaacctttttatgactttgaacgctaatcttctctcttcccaa

SEQ ID NO: 14912 - DNA, 441 bp, Saccharomyces cerevisiae
gggccttaaaaacatttacataccggtatacaccacatatttttagttacttgttcgaagctgtgctgctattcgttcttgcaaagccagtgtcctaacgactttgcttatgacatgattcaacatagtgttgttgtggttttttctacgtaatcatgatgatcttttttttcgcgctattaggggggagggaaggcgggatctggtaaaagtttgacataataatcaagggggatatcgtatccctttacttgaaaacttgaaaaatattcatctactatctctggccagaaaaacgtgagaatttttaggtgcgaaacatcatagaagctgcgattgtatccatctaagagttttaatttgataaagctaaggaatctgacccctatacttttttttttgtttggcttgcttgcattttcaatcggcttcaaaggtagc

SEQ ID NO: 14913 - DNA, 404 bp, Saccharomyces cerevisiae
aaaacattgatgttatggacactttttttaatatttaataataaaaacaaaatgaaaacaaggaaaaaaagttttttttttttttaattatgtataatctaagtaaataatatagtatgaacactttagatacaaaatattaattaatcaattaattttaaaaaatttcgctttatagatacatatataacaatgtgaactataactttaggaattttttctgtggaagagtggagaatgtgggtaacataattatttttttgtattcaagcttgcaacattgtttccattgttttttgcagctgctaccttatctgatgtgatactctgcaatttctggttataattttgagagggattccattttcttgtacttcttatttcgtctgcggaataaccaggaa

SEQ ID NO: 14914 - DNA, 490 bp, Saccharomyces cerevisiae
aattaatatattcgaacctttctatattgtgcttgtttttcaccagctcgtgtctacctattattaatttcatctgaatttggttcaagtattgttcggccaatattccggtattgtaatcacctttataattaattgaacaaattttataagacctaataattaacctttctcttgttctcctttgccgtaagagattcaacttttcgaagtctaattaaatgaatatgatctatgaagtatatatgtacaataaaaatgcctatattaataaaattcctgtccaaatgccagggcacttatgcctccctcatcaaacctccccaactattctcctctttactagctcttttttgaaagctacatcattgtctttgatatacgccattcttttttccaaagcagcctttgtggctattgctttaacccgatttcgatattctctttttttctgggaaatgtttgagggtaggtttgtgggcttctgatg

SEQ ID NO: 14915 - DNA, 428 bp, Saccharomyces cerevisiae
taagtctagcgaaattagaaaaattttcgtattttgtatttgaatttgagagtaggactcccctttctcatttttaatgtatatgtaacctctctctcttttttctctgcatcaactttttagcttctattctttgattctataggtatctaaacttcctaattacttcttaacacgcattaggacgtttttaattattctatgattttattaagacacgtttatcaattgccgtagatatgtatagttcatcaatattttcttttccattaccctacagaactttcatgttttttgttttcctgtctttttctccaattacgtgaaaaaaaaattgaattgaaatagcatgagaagctgagaaacaagtagaaattgacgaaatccaacgttcataagcatttttcaagaggtcgcaatttcactcg

SEQ ID NO: 14916 - DNA, 467 bp, Saccharomyces cerevisiae
tttgacgttttattccttttcttctgcacagaagtgtgtatatatatatttatatatagtcgatgtgcaaaagcctacattatttttcttttgatttttatttttttgttcaagtaggttcatgccgacagtaaatccttatgccctacctaaatataaacacccaaatatatatatatatatatatatatataaataataaaaacggaaaggaaatagaataataataataatactacacgtttacgtatgtaactcattctattattcagactttgatattaatagaattattactactaggtttcctcacttcaaaatctataaatataccgtcatgctctaatcgattggaaaactcaaaatattctcttactgtagcattgaacgtctcaattaaaacacagattttttgtatccttgttctcaacttcatatcttggatctgcttccaaattgtcacctcc

SEQ ID NO: 14917 - DNA, 406 bp, Saccharomyces cerevisiae
tgaaaacttagaatggacagagtacccttgacgtaactttacccatagaaatatctataaaaaatatgtatgtgttatgtgtatatgtatattctgaagactcttagcggaacccgtaaccttcagattcattaattgcccaaagtaatttcagttctagtttttttttcgaggaataattccataaacatatttcattaaaacatgtatgagccaatggcaaatcatcactatcatgcgaccctagcaagctaattttgaatgggatagtagagatacccgttgcaggtatacgatcagatgccgttacgaattgtaataatttcttctgcaatggatagtcccaactttcaataatttcccaaaaccagcaaaccgctctggaatcatcggagaagccacctac

SEQ ID NO: 14918 - DNA, 473 bp, Saccharomyces cerevisiae
attgtcagttagtctgcttttttacgtatatatatatatatatgtgtgtataatgaaaagacagtacacttaaaagaagagaaagtcatttaaaaaaagtcaaaaaaaaattaaacttgtaaatgtcagcgtaacgataatgtatatactttaaatgtaaactacaatcttgaagatcttttaacacgagcgcaatgtctatcgaacaatttcttggctctaacccagacaggagcagtttttctttgaggtaggagctctaaagatggtaagagatcatgagagaaaaattctgaagcttctcttggcagcaaagaaggcaagtgatcaatagagatgacagataatttaggcccggcagtggtaggtaccagaacggtaggtttgttaaacacagtagccacagtgtatattgggatggggttgtgagggttggtagtgtctgctgatacgtccaccacggtccttagtct

SEQ ID NO: 14919 - DNA, 467 bp, Saccharomyces cerevisiae
ttctcgaaaagtactacaatcttcccccttccctcaaaatatatccattcacactcatttctttatttccattgtctcactcaaattgctaagaatttgtgtatttgcatatatatatattatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcatctaaacgatcaagagatgatgaagcagacgca

SEQ ID NO: 14920 - DNA, 416 bp, Saccharomyces cerevisiae
cgtgtaggatagtgtcatctatttaaatatcatactatgtatttatgaatgagaacctcatgattgtaaacgagaaacactcctttaaatagcctaaaccgtatcctcagtaagaaaaactagaaaatacggtcctaatacttgcatgtgttttatgagtgacgaaataaataggaaaagaaaaatattttaatacaaactatcatttattgaaatgctctttttcattttcttcattaaatcattgtatgcaggctgggaaaaacaaccttgcaatctcccaatgtgaaaaaaaaaagaaaatgaagatacgaacatacctgaagtgggaaaggcagttgccacaaccagaagagcataacatattgtcatgacctctttatatgcacctggggcggaggatattcggcaaaggt

SEQ ID NO: 14921 - DNA, 429 bp, Saccharomyces cerevisiae
ttgtaaaaccaaaacactaccatccagactttttttttattcaaccatagcctttaactactactactactactagtactactactattactattactattactactactagagggcctttttttactcctagtatttttgtactatcctatttactctcgttgtttttattagttttttcactctttttttcaattcctcacgaatctactgttttcgtagtgcttttttttgtttcattgtttatagccatcaatggtttttgttactatcattatcattataaatatttcatacaatatatacaatatatatacaataaatgagaatcgatttacttttaatgcatttttgcagtcaaaaaaagcttcgtttacatttatatgtatttatgtttgtatttctgggggaaatatgcctttatgggcg

SEQ ID NO: 14922 - DNA, 400 bp, Saccharomyces cerevisiae
taaactgataagattattcaagcttaatcttttttgtacgagtacatatatttccatagcacttcctaattgacttttttttaaaataaataaagaaaagaaaattaattttgtgaccataatttcaacttgccttttttttgtacagggtttcagggataaatggacccttgaaagaatataatattacatctctatatagatttatgaaacaggccgctttaaatctaaaaaaaaacgttggtgtagtctcagtcattactttgtgtagtttttgttaatattgatagcatcagtgctcaagaaaataaacactgagaaagattagtttttgaaagaattgagatcgacctccccaaggggttttctttcgtatgcattgaactttaggcggttttcc

SEQ ID NO: 14923 - DNA, 434 bp, Saccharomyces cerevisiae
atagatttctatacactttccgccagataaataacgtatgtctctttaaactatgatctcattttctctagtaattttgaaccgcatatatgttactagtttacgttttcaatactatagaaactccgcttggaggctaactgcgcccgcaatccgaaaacttctatttacggacataaattagactctaaggatcaaacaaaaataaaaaggttgacagataaaggacagttttaatttttatacttttgatctgaaataatgccaagtcctaaacttattataatatagcctcgaacacaagatcattgagttgctttttctaacttctcctttctttattttactttagccgcaacaataccccttctattttaattctgacttcaattcatttcaactttacgaccttttttttcaatttcggttctgca

SEQ ID NO: 14924 - DNA, 500 bp, Saccharomyces cerevisiae
aacagctgcttgggttatatagtcgatagaggacgtataggaaagatagcttataaggtttttttttttttcaatttcaactagtgttgcatgaaggcctcgctacgtcatttccttcatttcccagaattctgcagaaactttatcaaatcactccaatgatcagtatccgaaggttcggcactacatagtttcgtttattaagtccaataaataagcttttttgtatgcacttttttttcgctcatgcataatggatatagctgactgaatgtcagtagtaatatctgcgagaaaatatgacactaattcttgaggtttgttgatttacgtaatatggtcctcgtatagttagaacgttgttctaaagagctaatggcagtttcactgcagcgaccaaacaggcaagttacactctctgagaactaaacttcttgaattgatgtctgaccacgttggcatttcccagtaaattcaataggctcaaattagcggaagaa

SEQ ID NO: 14925 - DNA, 414 bp, Saccharomyces cerevisiae
ataagatactgaaaactagagctagaacttataatttcatacatatatacatatcaagatctaataagaggattagctagattttgagcataaattcgatagcgaatctactcgaacatcgtaactgcacaaaataaggcgtcaggtgaccaggcacctcttctatttacaccaacacagacgcctttcatagaggaatagaaagctatattagaatcaccaataatgcaagcgtctcctgtgttctataacgtgaaccataagcttgagtggtttcaaaaggattacggggcggatagtatcttttgcgtcttcgttggatagtttgttattaagatacataaatacacactaaatttagtggtaaaatcttctattcaatattatcgagagtctcggtttgagggctaacac

SEQ ID NO: 14926 - DNA, 454 bp, Saccharomyces cerevisiae
aaccttgtccctcatgtgaacattgtggagtacttcttctagatgatttttactttacgcaatgtactacaggaaaagaatacaattatatgtataaatatagtatacaaaagaaaaaacaatattaaaatatgaaaatgacggatgaagtcgttatcttcttttataaatacagggcttcaagagccattttccttcggcaattttccgtcttttcttttctaattcttccttctcagtttcaacttcaataaacttttgtcttctttccaatttctgccttctctcttcaataatctccgcaggtggcttgaaaaattcgaatcttgtaaacatcttattctcgtcgaaggtctttttgtgaaaaaatcccatcagcttcaaagcgtctacaaattcattacctttgccgtcactaaaccttgatttaatttctgcgatccataattcaccc

SEQ ID NO: 14927 - DNA, 462 bp, Saccharomyces cerevisiae
tctcatttcaacgactctctttttctttttccgcctacctataaaaaaacaagacattcaccattatcctattatcccttccatcaatacatatacttaacataacgtttataaaaattcaactatcaacagtctttatattttttttttttcttttgaactattgcctctttgtcacttcgtcttaaaggggcgttttttatttttttttttttttttcagttgaggtagatgcgagaaagtgctgtatttattcaagggccacctcagtaaagagaagaaaagagagaaaaaaaaaaagaaggtggtgtatgtgcgaccactcaacaaggcccagtgaagttaatatataacgataaaaggaggaggacgagaaagaagaagctgaaaaacacaatggcgtatgcggactcaccagaaaatgcgatcgctgttatcaagcagcgaaccgcactaatgaac

SEQ ID NO: 14928 - DNA, 450 bp, Saccharomyces cerevisiae
atccttgtttaagtaaaccatttatgtaggatagtaaaacttccaactatttttgaagtcttatggtggcaccgcaccttctttgatgcttaaaatttccaggattgcttcacaaaatataaacaatccggccaacgcattaaaactaccactgctaaccagaaagtaaatcagtaaatcacttacttacaattactacgtatacaaagcaaacaatcacatttcatgtctgcataattgcacagtgtatgcataatgcattacggcaccaaatttggtgtgtaaaggataatgcgacaccggtcttagagatttttgcacgaggattattgccgtacggctatttggtgtcgtctcactcttcgccgcgccgggacggccaaaaatacaaaaaaggtcagtcagggccggcaacccgatgaggaaagggcccttccagtaaacttcaca

SEQ ID NO: 14929 - DNA, 450 bp, Saccharomyces cerevisiae
cagtaaaataagcaataaataatcggttattaaattatttctaatacacatatataacgagaataaaaaaggtagtcaccactaaccaaaccatattgattaattgatgattactgcctctttttttccacaggtttgttatcccataatgattttaaagaggcaataagaccagcttcttgactctctaatttatatataccgacgaacgataaaaaggagcccaagctcaataaatacatcgcgtaatgatgtacctttccatagactctttcagaaatatagtctataatgcaagactgaaatccgatatgacaatgacctagcaggaccaaggaaagaaatgtgtcggtaaaagtggaaatagggcctgtagtgaccaagggaactgcgatcagcggaagaaccgctaaggacagtccgcgctcgacaatccaatggtacgaaccc

SEQ ID NO: 14930 - DNA, 490 bp, Saccharomyces cerevisiae
gccttgtaatattgcattacattctagttttctaatcatatatctttttataatataataccaatagaataaaaatgtataaactgacattgcattcggtctttacgactctcgctttatccattcagccttttttttttttttttttttttctctatctgctaaacgagtagtagtataatcaaaaatgtgttatttagtatatcggttgtaaaggagaaagtatggtctctctatttttattttattaacgaaaaatactaaacgccgatggggattactatataattataatagtatttgcagaatagtagaattcttttcacagttcacgttcagtttctcctctgttttatcgaacgtttattcatcatgtccaaggtctatctgaattcagacatgattaaccatttgaactccacagttcaagcttactttaacttatggttggagaagcaaaacgcaataatgcgttctcaaccccaaatta

SEQ ID NO: 14931 - DNA, 488 bp, Saccharomyces cerevisiae
actttataacacttactgggtttcaccagcaagaccttgatctgacagaaaattactcttatgtatctgaaaaataatgatggtatttaggcatagtatttatcaatgctaagaaatgtaaatggactgaatgtacactcaatgctaacggtcaaggtcataggacgtttgcgtaataaaagaaactctactagagttgaacataatttgatataaaagtatataaattgaaaaggcagtttcaatcattttagtttctgcaatttatttattcctgtaatctacaattttatagttgggaaattctctcgaaaatattaagaaaaatacagaactcataaggtcttttttattggcattttgaaatcccctcagataatcaaagatgctaacaaacaaaataataacggtaaaaaaaaaaaaaatacacgatggggtacagcaaacgaattattttatccacgtcttaaaatcctgtgggttgaacg

SEQ ID NO: 14932 - DNA, 453 bp, Saccharomyces cerevisiae
gagtagtctgctcagaattttatcttttttggcataacgctcccatcgtagtttaatttaatttaatttaatttaatataataatatcttatttttcatatttactgtcctttattttttttttgtttttatctcttctggtcagagttctgtttttacgtaagcggcagaagtatgcattcttcacattttttcctcctaaaggcaacattgaggccaaactttggaaacaaagatgatgtgaagtaattatttacccatcagaaatctatgacaagataagtgtactgcactggatatgagcattgcatctcagaaaaaggttaagccatcgtttgtttgcttgcggtgtaagcaaaggaaaatcaaatgtgataaactttggcctacttgctccaaatgcaaggcctcatcctcgatttgtagctacgaagtggaaccaggacggattaa

SEQ ID NO: 14933 - DNA, 452 bp, Saccharomyces cerevisiae
gacgtggataaaataattcgtttgctgtaccccatcgtgtattttttttttttttaccgttattattttgtttgttagcatctttgattatctgaggggatttcaaaatgccaataaaaaagaccttatgagttctgtatttttcttaatattttcgagagaatttcccaactataaaattgtagattacaggaataaataaattgcagaaactaaaatgattgaaactgccttttcaatttatatacttttatatcaaattatgttcaactctagtagagtttcttttattacgcaaacgtcctatgaccttgaccgttagcattgagtgtacattcagtccatttacatttcttagcattgataaatactatgcctaaataccatcattatttttcagatacataagagtaattttctgtcagatcaaggtcttgctggtgaaacccagt

SEQ ID NO: 14934 - DNA, 422 bp, Saccharomyces cerevisiae
caatcctaagtattttcatttacgatgtatgtaagatttttacttattttttttaaagttttggtcgttgaaaaaggattcagaacaggcaaagattatatattaacgatatatatgaaaaatgaatgacaaatttataaggaataagttgaacattaatagctgagaaaattaaaacatggagaataaatatattatagaaaaccaaaatttttctaaaagaaacaatattattacaggaaaatattcgataaaaattttttttgaacccattttgtatatcattttcttgacctatgattcagctaatttagtattttccatttcttgagtgcatggaatttttttatttaaatgttgcagaacatggtctcttctcttgaatcttttaccgcatcttgggcaagaatggggtttctcac

SEQ ID NO: 14935 - DNA, 410 bp, Saccharomyces cerevisiae
ggcttgcagcgttgtcttttcccgctgtttccctctccctcaaaaaaaaaaatcttttacaatgactaaaagaaaatattgttcatttatatggttttaagtattttgtagacatttaagcgtatatacttgttctgaaaacatttatatattctattttgtatattcaacttattaaactctgacttttgctattgtcgcgtatatgtatatctttttttcttgtcgtggaaaattaaagcaaaatatgtcaggcgaatgtacacacaatgcagaaactgatgcggttaattttgcattctgaaacgatttaaacgaacagcattaacctccacgaccatattcaaacgattggaaatggaccaaaaaggtatgttctggctttattttcaattatccgcccttcgtta

SEQ ID NO: 14936 - DNA, 488 bp, Saccharomyces cerevisiae
attatttttcttcttcctttttctcatacatatctgaacgtgtggttaatgtgtctgtgtattagtgtataggatcaactgcttgggagatgaaataacaaaagtaccttaaaacgacctcattatcacatttttttttttactttattattttattgtgctttttagtgttgtagaaaaccaaagcaatccttttaaatgaatttttatatacatacgtgtatatgaatatgaatatgagtttaccccatctttaagctctgctgtgttttggaaataaattcacatattcatgtttagttttccttttacataatttggtcttagtacagagaagtcctcttcttcgcttcttcgcttttggtctttctgaaaaagatcgataaataacatcctaaagacaggaactgaaagacaacacagaaaaggtataccaagggaaaaacataattaatctctatagctttcaagagcgaaaatatcttcca

SEQ ID NO: 14937 - DNA, 494 bp, Saccharomyces cerevisiae
gtcatgtactgacccattaattttcttttctcttttttttttttttttttttttttcctctatttcctttttttgttctagtcggttacgcagttctgagtaatgtaatatagcgttccttttcctctcagatttttttgaccttattttgtttccactttttactacttatgctgctttttgtccatttccccttcagttgttttgaattttttttttaaaaaaaattcgtctttctgattaatcaattttgattatatattttctcttgattagttcacaatttttataggcccttatttcttaaagaagttttatgaagtttcgtaagtattgggggggttgaaaataatctctcacgttatacgcaataaaaaattaaaattaaggagaaccaatctatagaaacgaaccattgaatttagctatatgactatataccattacgtaatttatataaacagcttaatatagcgaaagcaaagtagaacgaa

SEQ ID NO: 14938 - DNA, 487 bp, Saccharomyces cerevisiae
acaatatatacctatgcccttgaccgactcaattgatacattaacagtattgaaactagatattctacttgacactaaactttttttgtatttcgtggaattgcaacgtttctaattgaccgacagtgctgaactgtgagcgaatgcaactatctctatagtttttttatcctctgtaaactttaactaaatacatactactttcataatctgtgaataagatgtggctgtgataacctaaaatagtcacaaaccaatgaaaaaaggcttcagaaaacttgctgtaaagtccccccacttttttgtgttaccgccacctcgagtgcactttttttaataaagatctcgtgtaattgtccaaatctgactttttcttatagtctcgctggaaccacagtgcggctttgcaattttgcaaatcggaatttgagtcacagatcccagaaaaactccacaccttccccacgcagcaagcgataacgaacaa

SEQ ID NO: 14939 - DNA, 436 bp, Saccharomyces cerevisiae
tgaatagtgggtaatttgtctttcatgaatttttgataattaaatagtttacagtatttacatagattatatacgtatttttacatatgtacagtttttgtgtgcttatcttctttacgtgtcgatgcgttccttgtgcatcgtctgtagatcaatcaatctaaaaggattcgactggatgtacttatttacaagtaacgaggaactcgcacgttttcataaactaggatcttatcacctggtttgaaaccctcgaatccactctcaaaagtgattccacattcatgcccttttgaaacttctgctacgtcatctttattgtgcttcaaagtagagattttcccatcaaaaattacatcttcgttaggacctctaactacctgcaccaatgaattctttttgatgacaccgttgtttactttgcaacctgcaatcc

SEQ ID NO: 14940 - DNA, 410 bp, Saccharomyces cerevisiae
gcaacttcttttcgatggcttgatgaccacatggctatgattttaattaatatatatacatgacaattatttttttatacattagcgatacctaaaatttcttggttaatacccttttgacagcctctactgcattgcccttgataataatttttttcgattgcatcaccacagaccatgattttttgggtatgaaaggcagttgctcctgcaagtcatttcttagttgaattacatctccttcaatctttctgatctccgtgataatcttgttacctccatttttataagcggaatacaccggtagatttccggtcctgcttctctccacgtagtaggtctttttaccaaaattgttgtttcctatgagctcatgcatcttcacgtcttccagctttggaaatattggc

SEQ ID NO: 14941 - DNA, 416 bp, Saccharomyces cerevisiae
agaatatatactccacatgacatacgaaatatacgtatttattgttctgtatggaataacagcgattacataaagatgacatgttacttctttattcaaattaatcttgacgtgcaagggcctgcttgttatttcatcggacaatcccaacatcactttacacgaaagccttagaagtttattatttgttttaagttggactatagtgatgtaggtagtttcttaggaagcagttgagtagctgatttttgagataagaacctggtgtaatcaatctataaacagcctagaatctttttaagcaaatttacttttacatttatctctatcttctttcttacaagaagttattttcattacaaaaggacattaaatacactaaattttcaatctttacattgttggaaagcctcgtt

SEQ ID NO: 14942 - DNA, 455 bp, Saccharomyces cerevisiae
gagtaggttagtttataatgttatgtacttaataggttatttagttttcgttcttttcattctttcctttttctttccatttaatcttatgtagttacattatactgtcattttagttgcagtaagtatacttttttatctagtctttttttctgccttttttttgagaaaagactcagaattctactaaactctaatatattgttatttctgtattatacaattctatgctatgtgaactgtccttgaaagtgacctaggccacttcgacaatttcatcttcttcgtcgtcatcttcttcttcttcactctcctcctcttcttcctcttccgcattctttgatggcatctcttccactgctcccgcacctggctcgcctctcattaacatattaacaattctgtaacataattcaccaatatcttcattctcaacgtttttatgcagctccctc

SEQ ID NO: 14943 - DNA, 491 bp, Saccharomyces cerevisiae
tatgcgcagtaatttttgtatggtacataagatgaagcaagataagtgatagtaatatttgttaccatgtatatgtttaatgtgataacacaaaagcgtaatatgagtaatgtttcagtaatgtttcacacatagaaaacatatagtggaaaacgtattgtagcaaacctctaatccggtagtacttgagaaattatagcttctgtgtacaaaaacagtacctatgtaattcttacatttacataacatatataaacttactacattatgacatataagctaaatcgtaatttactacgtcaacaatatgtcatagtgtagtgatatcatttgcgattatatcctacaaaaaaaaagcacttatatgaccaaaaatgtattatctggattttaagttaccgctttaatatatgatgttctaatgtgaagcctgtgtacatattgattagtatgaaaacattattgaactttcatgttaatgacaccatggc

SEQ ID NO: 14944 - DNA, 486 bp, Saccharomyces cerevisiae
caatctctgcttttgtacattcgtagttttttcatgttcctttcataaataataaaaaaagcgtattcttttctatataaatagaatgaaaaaaagttgaacataatatcagttaaggttaaaataaagccaaacgatataagcaacagaaatgagtgaacaggagccttacgaatgggctaaacacctattggacaccaagtatatcgaaaaatacaacattcagaactcaaacacattaccttcaccaccaggatttgaaggtaattcctctaaaggaaatgttacaagaaaacaacaagatgctacatctcaaactacttctttggcacaaaaaaaccaaataacagtattacaagtacagaaggcatggcaaattgcgttacaaccagccaaatctattccgatgaatatttttatgtcgtatatgtccggtacatccttacaaatcattcctataatgactgccctcatgctactctctgg

SEQ ID NO: 14945 - DNA, 481 bp, Saccharomyces cerevisiae
ctcctgtgaaattaaaagtattctccatatatggagcgcgaagatcacggcctaatcctcatgattcattttatagatgctttatataataattagagtacacatagttttcatcatatttccgttaaactggttgtactgtttggccgtatgtagaagtattattttccatgtcagagacttttattttttgtatatttacctttattatggctgtatcttctcctagtataaaaatatctgcgtctggattgactgttaataacaaccgcctataataagtagattcttcactattagggttcacaatatcagcaataccattgatagtagcgctcacttgattcaattcactttggttcaaatctcgtaaaaagttgttaaattttgtagactctgactcaacaaatgaaaaatcatctttactatggacgcttttttttcgaagagttaaatttttagctgtgatccaatcgtgaaa

SEQ ID NO: 14946 - DNA, 477 bp, Saccharomyces cerevisiae
attcccttcgaagtatgcattcacccttcctcgagagggctgtttttatcttccgtcacactaatagaaaaccactctatccagttttttttgttacttaacttatcttaactcgatattgtataaatactgaagtccatatacttctttttttctcctttggatagtaaatacggtaaattaaaattagtgtaaactgaacaatattaacatatataaatcatctgtacgacaatttgataccaaataaatagagaatgcatcagcatcctccagggttcaaaagaaaacgctggatcttgcttcttttcctttgatttctccttatatccatttctgtcttgcagcaacttcacatattttttccagtgtaatgacccttggatcaggcttaaaatgacgctcaaccacattatcatctccttccacattcctgctaagtaagctttcttcgtcgccctcgctattgtccacatt

SEQ ID NO: 14947 - DNA, 498 bp, Saccharomyces cerevisiae
ttattattattagttaccatgggtcactcctattttagacacttaatataaacaattaaaaagaatgaaaaataatgcaaacgataaacgctaagtatgtatatatatatatatgtacaagttaaataaaaataacacaaataaattttagtttgtagttcacggctcacgagaaaaaatattgactgtttctcaatactgtaacatcaaaatcacctttaggtgggatttcaggtaatctcaacggtaaaagaacactcataccgctattttcatctccaccgttttctagttcaagtgcgtccaagtcagtgatgtcttcaaataatgatacagttgtaaccatcttttcaccaacatttctatcttctattagagggctgtttaataattcttgcctttttttctcaaaataaatttcatctgctaatgtagtacttcttcctaattttctggataaatctttacggattctaataatcttttgagccaaatccg

SEQ ID NO: 14948 - DNA, 446 bp, Saccharomyces cerevisiae
gaaagtgggcaggcgatacttcttttatcatgagcaatttttttctctttatatgtataaatatagatatgcacacgcatttataaatccctatatcagggttggatttcttctatgtttatgtatgtaaaagaaagaattcacatgtgataaattgtggaatcagcacatagttcttgaaccagctcagagtctgtgtcgtacccgacataagctacgtagccaggttcacctttatcttcgtgaattgggtagtggacgggtggaacattatcattctcgatgatacagaacgagagatgttcatcatttggttcataatctctagtgattctctttactatagttttatattcgcctcttttgtcacaacttggcccaccacgtgcccaaagcttgattactgagccagactggggttctttgattggggtacaatggaacca

SEQ ID NO: 14949 - DNA, 448 bp, Saccharomyces cerevisiae
tcatttctgtataagttttctcaactgaatatataaatatatatcattactatgctgctgctgctgcaaaaaaaaaaaaatttacgataaatgcaaaaaccatagatggtcatctaaagaggcgcatttctcaaaaatgtagcgtcgctaaaatggttttctctacctttagttttacgccagatttttactagacgcgttttagtttactttttcctaccctgttcgttttttttttttttttcgcaccaaatttttcaaccgttccatggaagccgggatcgaccgtcctacactaatgtaagcattagtccgctcgagggtccacgtttaattccggatcataaagtttttaatgtatttcttgttattatcgcttttgttgatcttacctgctattgcatagagacagacaatagacaaaccagattcatcgcttactcggtgg

SEQ ID NO: 14950 - DNA, 415 bp, Saccharomyces cerevisiae
aaatcgcttttattcttacctttatgtactgttgcctctatatgtcttcccttcatataataaattccatttctaaaaaaattgtagttgtgtttatacatgtatagatagataaatgaatgtgtacttgctgccttaacgccttccgctaaaaactttttgatatttattttatttttaacctttcctgacttcaacccttactgtaatgatgatagtagaagccgtctatttttcatacttttctcatgttgattttccttgcagacaaagacaatctcttggatggtttgtaccaaccaccattatctgaaggcatagatgcaggagtagcgtagtttactcccgatgatatcgtataagaccagccaggagttatcgtagttgcttgctctggcaatgacccaaaggtaga

SEQ ID NO: 14951 - DNA, 415 bp, Saccharomyces cerevisiae
caaagacgttgtttcatcgcgctattaccaagaaggttactttacttgttcttgcacatggacgcacgttgtgtgttcatatatatatatatatatatatatatatatttgtgcttgttttcattgtctctatagttaatacattctatttttatcgttatatttgcattctcttcgcataaaaacttcatgaaaattcggcagaaaataagccatatatgtactttatccataggcaaagaaaagcacttaacgagaatatacaacaattgcactagtactgcatgtatatactcttatgattatagcggcaagaaaacaaatataaacacactaacagatgaattcgaatgaagatatacatgaagaacgcattgaagttccacgaactccccatcaaacccagccagagaaa

SEQ ID NO: 14952 - DNA, 446 bp, Saccharomyces cerevisiae
atgtatagttttgcgctgtgtgcacattgtgtgcctctccaatttgtgttaaaaaatgcatcacgactcgtttagacaatgttgttgttgttgttttttttttgactgtattttcacccgtacatccacggatgtgttgggtttttgtttccgctttaccgtgcgggagacgaccatgaccgagaggtctggttgcgaaagacgcacataccgcgtgcgcggaactttttcattgggttgccaaccaaggctgttcagggaagcccgacgagggaagctagcatgaatgcactaggagagagagagagagagaggcagaggaagaggcacatcattgcatttcttgaatattcgttttaattagcgttaagtcttaagttcgtgtattaccatagtcaaaacagaatagagaagcaaggataatacaaaatggctgtcaagactgg

SEQ ID NO: 14953 - DNA, 451 bp, Saccharomyces cerevisiae
tgaggctttgtacaacgaaagccaaaatattcgatgaagcagcaaatggctttttatacttttactaagtatgcgcgcatactgatatatagatataaacaaaaatatacaatatttaaaaaaatcatagagagacgtctatattaattaaagtgctgtacgtttcccttggcattctgtattgaatcataccagcataaatcatacattgtctcgcaacattttttaaggaatcaatttgttgaccttttgtggacgattgatacttactttcgttcaagatatgaatcatgttcgatatacagcttagagtgataatcaacaaatttggaatatttttcacaatgttgtcatctaaattagagaaatcttgtgctttctttctagcagatagctcgtctgagaaaggaagtaaatccaataactccatttgggatagtgtttcttgcca

SEQ ID NO: 14954 - DNA, 402 bp, Saccharomyces cerevisiae
acttcgtgatgtatagagtattgttgacaaatatttgatgttaccgaaatagcactctttgtagcattattaccaatttttatactatgaagtaaggtcttaggaagcaagaacattgttaacaaatagcttttatgacctaatcattagcactattcattgccaaatatgcaaatatctattccttttgcccgaacaggtaaaagtggtattgcttttatgttaaacgcgaaactgccgccacttcgcttaaaaaaaacactggctgaaaaagaacgatgcagtttagtaactaaagttttttctagctcaggcttagagttcgataacaacaagtcacattcgagtgctccacttatagcaatttttcttttgtgtattggtttgctcctgtgtgctcag

SEQ ID NO: 14955 - DNA, 423 bp, Saccharomyces cerevisiae
aaatccaataactttttcgttgaagcatcaatttgcccttgataattttcatacatgtactacatacattttactcatatatcactattttgctagtattgattttttccagaagtattagtgtaagatttctcgaagtaagcatcaacatatccaaaacgttgacatatttctaggccggcaatgcacagaatttgtataaagggggacatgctgcagaaatttgctcaaaattatccatgaaagaagtaccaatgaagcactagcctgttcaaattcacttgatactcgagcataaagcataaactactgctttttaacttataatttctacctctaacactcagtgcagtctgtaataaaacacaccagatatcgttctattagtaatataattatgcttctcacgtcaaatttactagc

SEQ ID NO: 14956 - DNA, 474 bp, Saccharomyces cerevisiae
aaatagaacattttattccatcggatatatgataagaacaagaaaataaaacatcaagtgcctatatatcccatctgagtacgtaaaaattttgtaagaatacagttatgtagtaaaataaaagtaaataaagcgctaaaacaaaaaaataacttcaaataaagtcataaaagttaatgcaatgaaatcacatgccctcatgaagcatgcttttttaaaaaatcttgcatttcgtcagtgtcaatgtcttgtgggtcttcagaagatatggcctgtaacaaaccatcaagcatattgtcaactttattttcgtcgattttcaaacataaagataacactcttctaaatttattctctaattctgattgtttggtgctgattgtatccaatacattggttaggtgtttatcattccgcttgtatgcatttattcttgccttcaataagaccgttggtggaagcatcgattggatt

SEQ ID NO: 14957 - DNA, 407 bp, Saccharomyces cerevisiae
gcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacggatccacagcctagccttcagttgggctctatcttcatcgtcattcattgcatctactagccccttacctgagcttcaag

SEQ ID NO: 14958 - DNA, 451 bp, Saccharomyces cerevisiae
agactttttctgtgaaatttaatgagtttttgttcaccttttttacttttcttctatgccatatggttaaataaaacatggttcaaacgcgattcttttttattatctatgtctttattatgtagtcttcactataataaccgttaatgagcgacatagttgcatcagtttttaaggccaatttgattcagaaccttttcaagttcttcactttccatcttatccgaagacgcgatctggtggcatctaatactatgcttctcgaatatcgtttcatcaatttcaatttcaccattttttaggtaaacaatatcagtaataaaatcttgccattcaaagtcatcattctctgaatggacacccttagattgcctatagcctgctattgccctactcatagaatctatgatcatttgaacgtagtgtaaaccgtctaaaccaaaaacctctc

SEQ ID NO: 14959 - DNA, 466 bp, Saccharomyces cerevisiae
gtataatcgaacgctcttcttaatgagcatatacccgccgtccttacgccaggatggaaataatttgaatgaataatgtaaaatatataaaagtatctagtcagtacatttcatgtctcaattattaatatcttaaatatatatttagttatggaaattcaataaactactgaaataaatagaaaattcttacagaaaatggtaaaagtaaaaaaaaattaccaaagggtgcacttggcaatttaaaagtacttataaactggtttggcttccaagtgaatgaaagtgctatgggattatcatcaggtaagtacagtgtatcttactaacattggccgagcgtttattgttgttccgtggaagtttatcatgatttcccgcccttaatcgaaatcaaaaaaaaaaaaaataaagggtaagggattcctaaaaaccaacaagatgaagggctgatctgcaagaagtc

SEQ ID NO: 14960 - DNA, 428 bp, Saccharomyces cerevisiae
ggtaaggattaatgaccttgcgcaatgtcttctaaatatcttttcttttttttaaattaatgaaaatataataaatttttgtatgtgagtacatatatccgcagtatactataaatgaaataataacataagtgtttgtaactggctataacgtccttaaacatgtgcactgccattaagtacttagtcaatatttttatcgttgagaacgaacgcaaatcatattactaaatagatgaacaaaagcgcatcacataaacaaaaacggtataacagtaatagtgaagctttttataaacctataacgaaataagcgcttttcaggttttataattcagtcagagttctaactggacatcgttttgcaggggataaaaaaaaaaaggaagcttcaacccacaataccaaaaaagcgaagaaaacagcca

SEQ ID NO: 14961 - DNA, 411 bp, Saccharomyces cerevisiae
ctattatcggtaatggaggaaaaaaaaatttttttaccatttctttatgtaacttcatatatcatttttaaagcgtacatttcttataatttcacttcttaaatgcagtcacatatttactgctatcagacaaagtaaagcgtcgctaattacttgcctccacgagttgcttgtcaatcaggggcgcttcatctcgccagcgaaagcgcgttgtccatcttatttaacaagagaaaaaaaagataattcaacttaaaaagaacgtgctatcagctatataaaatgtagacacattatgtatcagtgtttctttagcaatgcgaaaaatataggcttagtgtcatttacttaaagtttagaaactctgcacacttcaccaagaacaagtttaaccgctcattactccaaacg

SEQ ID NO: 14962 - DNA, 415 bp, Saccharomyces cerevisiae
tggtaaaattttgtatgtgaatatcatagattaattttttcgaactttctataggtataaagtaaaaataataatatttacatgattaacgttgtcctcacaaatttatgatattgactcgacaaaatctaacacagtggaatcatcaccatattgacctactacctgtaagccaatcggggtcttctcttttaaaggcattgataaacttggtagtccagccaatgacattgggacagtaaagacatcgtttatatacgagttagccggagatttggcttcctcttcttcgaagtcccttatggatccaggaagcttggacgatgtgggaactatcagtagatctaggccgtctggatttcccttagaattagttaaaacatttggaaatctgaagatcccgtcaaattcatcg

SEQ ID NO: 14963 - DNA, 453 bp, Saccharomyces cerevisiae
atgctactatgattttagtacgtgtcgaaaatgttcgttccgcttatgattatattattatttcaacttaccagttaatgcttaacttttaaactgtcatatgtacttctctgtattatataaaaactgacaactggccttttctattgttgatttctttcatccatcgttaaatattttcagaatgtgggcaggaagacatgcatgtttgaaggtgcctatcctagcatcatcataaaagaaaacggtaaatcatttccgttttcaaaacgtacactacagcctccagttgatgaaatcagttctcacaataattcgaggtttaaaagaaacagtaaaatttaaaaaaaactattcaatagataaattggtatatacgaacattaaaaattccatttaaaaatgagattataataacatggcggcagcggccatgacaccagcacccatacc

SEQ ID NO: 14964 - DNA, 474 bp, Saccharomyces cerevisiae
tacgtttaagaacttttcaatctacgaaaaatatatgtccgcaatatagaacacaattaggtttatattcgacgtgatttttttttcttccttagccctatgtatatttactgtataggataaatgaaataccaaaaataaaaaagtataaaacgaaagaatataaccctcgtttatatctggtcatttgtcttgctcatttgttagcatttaaacttgctaatacgaaactcaatgtaaagaatactttaaaacccatgtattctgtacccaataacccatcaataagcagtttcttcaagtctacatctttcaaaacaattacagatttgatatttttcaaattaatgcgaatccatcccttgtaccgtaaccattcacaaagaagcatgcttgtaataccgacatacataaacaaaattgatatcttagccaccgtaactcctaaaacaacaccgaataatgatcccaaaa

SEQ ID NO: 14965 - DNA, 430 bp, Saccharomyces cerevisiae
tgatcttgaagtaaaagtgttaggaattatacctgcatatatattggtgtatacatttatattgaatttaatagcaacattatttttcattatttttcattatttcagcaaaaagaacattttttttcaatttgacgtgaaagagtttgactattacgtgggcatacaatgtttaaatttacattatcctcatggctactctagctatttgcatttcattcaactttttttgatatggcatcatttttattagcgtttactacactttcagaaatgccaatctttggtggcgatttgctagcaaccaagaatgagggagtcgagggctgttttaaatttgaactcgcgttcgaccctttatggcttttgtgtatatcaattggtttagaaggtagtgcgcttgacccatcttgtgcagtggtactttcgc

SEQ ID NO: 14966 - DNA, 485 bp, Saccharomyces cerevisiae
taaagttctgtaatatgtagttttgaaatcttatacattatttaggaaaaactttttaacctgttcattaagggcaacatcttctgccttagcgcctttattatctacaagatcatattctgcaccatacttttccaccaacaatacagctgcgtcaccgtgcccttcagccaaagcatgaaatagtggggtccaaccctgcttatcctgccaatttacagcgcttttgcccaaaccgcataatagttcaattaatttcaaagaacccaccgacgcagctctatgcaatggaatttgattaaatttatctttaattcttacggacgcaccattttcaattaaaaattgggatacttcaaaccatttcttaccaactgccaagtgcaagcatgtaactccttgattggttatcttatttagatcaggctttagaggtctgtcgtaaagagactttaccacctccaaattccccactgaacaagcaa

SEQ ID NO: 14967 - DNA, 417 bp, Saccharomyces cerevisiae
aaatctgtatagaacgtttagtcatgcggaccttgtgtgttttgtttctagattgttttatttttatgattgttgaagatataaaccactgtatagttgtataagataggataatgatggtgcactgaaaataaacttactagctctttaatattgcaacggcttgtaacgggcgccatgatgacattcagaattataccactactatatgaaaaaatgaaaagaggccctgctttgaacccgtacattttattctataatattgcatctgtggtttgcctgacggcagcgagtccaacacaaagtctggcatatgctacgaattttccaccatggattcagcacccaaacatttgaattttttttcatgtcgattgtgaaattttactgaagatgagggtaaatagaggcctgcaa

SEQ ID NO: 14968 - DNA, 420 bp, Saccharomyces cerevisiae
attattttatgcttctgtctttcctttctctttcgattattagaaggtgcatctttgtataaatatcccatcaataatgtattcttaggaatctatatatgtatgtacgttttatgtgtatatgtattttacgttttttcataatcatatactttctgccgaaattttttgccttcattatgcacactaatgttattaatcagataaaaatacagaaatttaaaataaatactgagaataatataattaactgttcgagaattgtcgcaaattaatagcttcacactactcccacaaggattcctaattcacgtgcaacagcaaccggatctttttgaaaatgctttcgaattggttgggacccagtttcgtagaatcctctttcatcaatctaatcagagaaacgaacccaacgagtgt

SEQ ID NO: 14969 - DNA, 473 bp, Saccharomyces cerevisiae
tttgaggtctaatcctccgtatacgtttatatatgtttagataagttggttttatatgggtaacccaaattactatttctacttctttctacgtccgatataaagaacttaaaagacaaaaagcagtttttcgaagcgacatcaaccaatctaagttaaggtatggaaagataaaatacaagaaatgttacgcaacatcatcaggttcaaaggatttggaaaagggaccagtggaggatttttaaaacctgtatcatttcgtgttcagttaacgcgatgttaccgctatgacaatggtccttcatatcgtcgatttaataatggagagtattcccaaaaatcatcgtttaaaagcattcttctcgataagtcatcaagaaaatacttagctttattatttggtggatgctctctcttttattatacacatttggataaagcaccggtaagcgataggtccaggttcatctggg

SEQ ID NO: 14970 - DNA, 486 bp, Saccharomyces cerevisiae
cgtttcttaattatgtctaagtatatacagttacgtaaaaatcaataaacaaaagtaaaacaatgctgtttgaaaagttatcaaaataataaatgtatgaagtattgtaaatgttcatgaataattagctggacgatttctgttataggtcattccaaccaaataaccaattactcagtttgtgcgtaaaaccagcaggttcattatttctgtatttcgcttcttgctgacgcattttcgattctaggtttcgcaacagattaggaatattcgaattcggtcctgcattttgcatgaatggcaatttgccatctattacatccagccgcttattcggagaatttgctactattggacttgaaatatttgttggattaccagcatgaccggcaggagtattatcgtcttccctcagaagagtgccatcagttattattacgtttggtggggatggtgtattagatgtcgacgatgtggaggaatttt

SEQ ID NO: 14971 - DNA, 432 bp, Saccharomyces cerevisiae
atttaactcataactgtttacaagattgatagatacctatataaggccacatatttcaagtattgtaaggatgcccttttagtgtcaaacttcttattatcacgaaaaacgtcgtcttttcatgcaaggaaggactacagtatatacatataaatatatatttatgtaattatttttttctttttttttaaattttctagcgagaatgaagaaaagccgacctcatctcatcctatttggaacaaattcgaatgatctgtccaatacagcaaggctaccttgcggttgaattctatctcgtactacactaagacgaaagagaaaaacgaaatgtccaagagtaatacttataggatgctcgtcttactagaagacgacaccaagataaataaagaagatgaaaaatttttgaaaggtaagccgggaaaaatg

SEQ ID NO: 14972 - DNA, 489 bp, Saccharomyces cerevisiae
aagtccacgcagtaccctgcataatcatgtattaccataaaaaggctttaatatgagaaaaaggtgagcgctatatagatttagtaatttacatgttacagaagcaaaaagcaaatatatatatattttttatcatattagtttttatcctcagtagtactactgaaataataatctcagatttttttttttcacttgccgagggaccttgtcctaagtggcaaagaactgaaaaaaaaaaaaattgaaatgcggtggtatcacatgaagagtaaataacttaagcaaaagagaggccactgagagagtacaagaaagggacaataacaatagacagaagacttttatatttgtaataacttagcgatgtcccaattattcaataactcgcgctcagatacccttttcctaggaggtgaaaaaataagtggtgatgatattcgtaatcagaatgttttggctactatggctgtggctaacgtcgtcaag

SEQ ID NO: 14973 - DNA, 472 bp, Saccharomyces cerevisiae
gacgagtaatcattgccgcgcctaatttttctaggtgttttcaagtgtcatactgttttagaaaattttgtatagaacaaatacgtatatcctgccatatcatattctttgcaatatacaccttgtacatttggctattataaatattacaatccatttaatcataatcaaaatttaatttctgttaccacggggttgtcagtggagcatgccctgccggttctctataatttatctttttcacatgagatatttttacctcaaaaggtagtgatgctgtaataatatgaggctcccccctttccttcggaattgcatttaaatcattggggaacactaagacaagacaaaggggccgtccactcatgtgattttcaacaaaacagataacatgcggatacacactgatatattttcaaaggaaagtctgactgatacttaagtgaagtggtcctagtcggtggcttaggtg

SEQ ID NO: 14974 - DNA, 442 bp, Saccharomyces cerevisiae
gtgttaagaatgtagctttttcgtcaaagctgggtatttttctttttatagcgcaggagcggaaggcaatttccaaaacaggaatgtactttccaaaaaaggaaaatgtagtttgttttttgatgtttttttctctttgactatttcaaatttagaagtgaaaaaatacaaaaatgttacataggattcgatacagtgtaatatatcattattattacttttaaataaagcgtttagtaaacaagagtgagggttatgcaactcgtttagtaaacattcttttttttttcttcatttaagtataagacaacaatagtagcggaagcgatagtaatacatttggtagcgataagtgcacatgcaatttcactcagataagcagcatttggacagtaaaaccgacatcgatttcaagccaaactcaccgcgttccttacaaaat

SEQ ID NO: 14975 - DNA, 477 bp, Saccharomyces cerevisiae
agaatatttttagatataaggtagaatacgtacatttacggtaaaaaaaaaaaaaaaagaaaaaaaattgatcttgatacatacgttggtattttactttgaagactgtgcattgtgtatgtacgaaaagaaagggaaataaaaaataacgacaactgcaggactcgaacctgcgcgggcaaagcccaaaagatttctaatctttcgccttaaccactcggccaagttgcctttaatctcttgagtttgtttaaggacaacactgtccacctggcatgggaatattaccattattccagattcgggcttgttattaggactttttaccagcttgatttaccggtcattacttatcctacacatcatacatcacaactacacttggtgaagaaatcacagagccttggatttgtaacaattatatgtttacgcaatttatcttgggaaagcagggcctcatttgtggacatagcacgg

SEQ ID NO: 14976 - DNA, 403 bp, Saccharomyces cerevisiae
gaagaggcgagggttagaatcaagacttttaaagaaacttaatattatactgttgccttttttttatagttattttatatagtgtatttctaaagaaaaagatgtgttattttttaaacatccaccttttcgtgtccttataagattcatgagactttttatatatctccttctccatttcttctagtttcagtaaaaatgtgctagttgctatattagtgttcgctgaattttttccggtcgagtctgcattgagatcaatcgataaactactagcatgatgattaagttcttgggcacgttgcaaaagtagctcactaacgacattggccagttctttttcgctaaacaacattatccattttatggctagactgaagaaatgcgaatttatggaatgcaa

SEQ ID NO: 14977 - DNA, 428 bp, Saccharomyces cerevisiae
gctccaaaagaaacgacagctctttttacccctccagggttgtatttatcttctaatctaggacaatgtttgtaaaaccctctttctttccttcgtgtctcatgtctctccatttattaatgttcttttaaactatgttttctcacgcctgtccattcggttctcgtacgttaaatttttcaaattattgttgtataattatataacatctatatagaatttatgaacgtccggcatttcgaattactctctccacatcatcattaaacttttcaaaggctttattggaacttgtgtttgaatgtttgcttcttttttttacagtaattaccgatgatgcattgggtgtgctagtaatcttgattttgaatttgaagttgccttttacaaatttacaatcgtattccaccacctttctcccaaatttg

SEQ ID NO: 14978 - DNA, 417 bp, Saccharomyces cerevisiae
cttattttgcaggttatgtaaagctacataatataataatgaacagtgcaagtgcaagggtggccctttgttgctatactgcggactgcgactgtatgagctttttccatcccagttctatccattgtgtacttttttttttcatcgccttacgaacttcaaaaatatgtaaacaataagataagtaaattaaccgaagactctcatgctttgaaagcgccataagtgcgcgtgtttgtgccttctgatatgatatcgtatgcctaagtttccacagtttcgattgattttagttttgttttacttaatatcaatgatacaatggtcggtaatcactttttcgctggggttctttcttaatgtctgcatctttgcgtacttcgtattcttcaaatccttgcctgatttaccgaaacc

SEQ ID NO: 14979 - DNA, 456 bp, Saccharomyces cerevisiae
tagatgcggtggtcgaagcttctattacatgcctgaggtgcgggtctcacccttgagcagcaagtgagaaattttaccctaatttcgtcttcttttttcttttttcttcatctggacctattattggtcatgatgccactttttacaaactatttcatatgtttaatctagtttatttagatctacagctgtcagtttatacgtttttattaatgtcagtttgatttgattagtagtgacctttttcgtcgaggtatgccgtttcacggacctccagatccaggtgtataacaatagaattatgggaaaacggggtgggaaggtcgttgtctaactcaaacctcctggaattagcgggtaaagtgtcgttattgtgctgggcaacaacttttttttacgatttctttttacctctcatctaggttagtgttagttgtaaaaacccgagcagattgg

SEQ ID NO: 14980 - DNA, 462 bp, Saccharomyces cerevisiae
ggcaaataaatagcgaaggctagatattatctttaagaattgagtaacaatgttaagatgccatatacttgtgaatacaaaataaagggaaagaaagcgatgcgtaaaacataaatatttgtatgtcttctagaataagaataaggagtattaccccgtatcatcttgtattgttggagaacgtatatagtataatatgtaacacatacagcaaaaaaataggccaatttatgatcatcatccgttaaattaaatgtctacattcggcttgcgtggtatattctgtttgccccgcacaaactccagtgttttgggttgcgatttggctgagaaaagttttgacttgtgatcattcagttttctagagcatggtgaaagcaaattgtctgacggcgacgcaaatttttgcctaagttgcgtgttcaagtttttcctttgatcttccactgcttttcttttccg

SEQ ID NO: 14981 - DNA, 483 bp, Saccharomyces cerevisiae
gtgttttattgattttttttttctttttaatttaatgcaatgtatacatttacataaaatatggacaaataagaaaaagggggaaaaacctcccacttaagtaaaactgaatatattagatacctttacctactatcaaaggtgaatgcttttggatcaataggggttccatcgggggcaataccattttggccgaactttctttccatatataatagtctagccttatcgaaatctacattatcgttttccataatttgtttaatctcattcttggagacatcatccaaaccacctcttacgtcgttgctattctccgagataatatcgaaattcctggaatggagaccgttttctaggtcatcagcaaaggaatcatttaaacgtatatgtctattaaaacgtaattgtattcttgaacgcagtgcacgaaatttgtcggctattacagctgttagtaatttgatacggtttgcactttgc

SEQ ID NO: 14982 - DNA, 411 bp, Saccharomyces cerevisiae
ccgggctgagaaacaaaaaaagtgactaagttctgtcattctatcattattgtaattagttatgtaggacatatatatccatagtgatctccttttgatcaaagaagacactgaaaagtcgtaagttcgtaaaaaaagtatgaaaatcgttccagccattgcttatagccatcctagtaggatactagaaaaaaaacaaacctcaaagataaaaagaaaaggtgaagctattaccgaattagaacataagataatacagtgagtataaaggtgagacctgctcaataatctggtaaccatttctcgtttggaccgtctgttaaagtagaaaaattcatttgtaagcataatagcctatttcttaatgtatcttgttggaatttgcaatctttggaagcactaacgtcatcg

SEQ ID NO: 14983 - DNA, 437 bp, Saccharomyces cerevisiae
gccaacaagatatttctacgttttttagtataataaaattttgtataattcattttgtagattcaaggaaattttaaaatatatcctgtttcttctcttacattatgcactaccagcgtgaaagcacaatgtcatgccatgtatctttacaaaatccagggtccatagcgggtaacaaattattggtttttctgcgataaatataaaacgtagcgtaattataaaaatcctgagcggtgttgtcgtagagcagttgaacattacgtaaacagatatctacgcatttctgtcatttggattcatacagggtttacagacaatatggggaccgaagatgccattgcccttccaaatagcacgctagagccgcgtaccgaagctaagcaaagactatcatctaagagtcatcaagtctcggcgaaagtaacgattccagc

SEQ ID NO: 14984 - DNA, 452 bp, Saccharomyces cerevisiae
aattccctctattctacacttatttgacataggatgtgctatattaaataattatatataggtatcaaaatgtacgcgatggttcagaacctgcaattaatttaacacctcaatcatacttgtttttttcctttttcaagaagtttttgtaatgtgtcgtgccgatctgtaaacgacctggatttttatttcattagacagtaaatacgcaccaaatcagaaccaaagaaaggcttctgtagtgtatgaaactaaaagccactttttgtgatagtttcttcttagtacttagtacacaaccaaatattttgcaaaatgaaatcgattcctaaaagtaattcttaaaagtgataatgaatgacttaatcgttattttgatatcctgttaatgtgcataacatcacaattagcttcaccatttcgtttaaactttggttattaggatccgacga

SEQ ID NO: 14985 - DNA, 474 bp, Saccharomyces cerevisiae
gccaatcgctgaaaaactagatattaatgttgcagttaataagctcattgaaaactttctttggttgttcctcttccttctttttttcgccgataaagttgtcgttatagtttcacttatatcttacgagaatctaaataagtaaatattaatattattcaatttctcatttcctttcctctgggttttttgagagtacgagttttattgctcgctttttgtattttcactttgccggctttttcactattccctattgtcttaataaagttcctgcttgggcccagtaaacttttaaaatttatgtgctgaaagaaagttgaaacaatcacaagaggagagcagatttgccaaaaaaagaatctgagctgtttgttcctgtctaatactaaaagatataaataaacaatatgtatacaaaagagtactactggttttcacaatatatgataataacaagcactttggtgctca

SEQ ID NO: 14986 - DNA, 491 bp, Saccharomyces cerevisiae
aaagattcggaggatggactacattcgttatcactccgctttttaatttttaatcaatgttacatacctagcgtaattttcctatatataaaatatcagctttatataaatatattattgaaactgtacctataataataaatttaaaattaagtaaatacaaatgcttcaaaatttgttagtattgttttcttcaatcatctttacttaattgtcatcgcaataattaaattaatattttattgttgttgcgtatataatacaacctgaatggtatgctacactatgttacactatgctattgatcagagtttctaatgacgaattacacttctataactatccgctttggaaagtttgagacgaagggcgttacaatcagaatccgtatccaaaggatgttcttcagaattagtcagatctacacctgatgaaacatgccttgcgacagtacttatgctactttctctaaccaaatgtgtaggcggttc

SEQ ID NO: 14987 - DNA, 492 bp, Saccharomyces cerevisiae
tagcattgctcagagttagacaaccaccaaagatagtattcctctttatgacatcgagtatagttgctatataatatataccaagacattaaaaaatatatgccagtgctatctttgtaggagctaataaaaggggacgtcgacccttcaatgtatatatcgatcctttcacattagtcaggacgagataatgagcatgatgtataaacaaacggtagttaataccaacgataagttatacaactactgtacaataaaaaaacatcacaatagcaatacaggagtcctattcgctacttcaacttgacaagatctactagatatagaaatatctagcttaatcaacaattttcctcactgattgcttcctccgaatgccattattggctttcttggttcttaagcatgatattacgtataaatagccattatatcaattagaacaaaagattacgtaaatgcaatttttcctgagaatggcgttcgaagaag

SEQ ID NO: 14988 - DNA, 401 bp, Saccharomyces cerevisiae
tgggacgtttagtgtagtagatagtaagtactttaattaccccccctgtttttagttatacatgaaaagataattgtgttattaatgtagattaccatcaaatagctggaatatttattattttgagtatgttgaatggcgaaagtaaaaataaattttataatttcctgaaagcattagtacacgaaaagggccgttttcagtagtttaaggcgctgaaaagacatggtctagaagttaacttgagcttgagcctattttctacaaatgtcctttgaaaatacaaaaataaaaataaaaatgcatttaagtattaagcttatgctagatagagcaacattttcctaattttttttgaatttatttcatggtttttaggcggaaagagtttggacggcttg

SEQ ID NO: 14989 - DNA, 426 bp, Saccharomyces cerevisiae
attgaactgaaaaaattataaatgatttaaaatagaatttcaaaacaaggagaattgatagagaatgcgttgatctgaaaatactgtttgacaataacggaaaggtaagtggatatgtaatctaagtttaatcctcttctaattcatttttcctatcaacattatctgtgcttttctatatccttctttttgtatctataattttttttttctcttacatagcaaaatacaaaaaatcataaatattaatatctaagggttcaagatcaggtcatcgccgttctgggccactaggctatatctattcatttacattggaagctgcatggtctactccaaccgcactgaggcaaagtctctgtggaggaaatgctgtcctagcgagccattgcaataggtataatcagagtcgtcctcccaatgtgt

SEQ ID NO: 14990 - DNA, 415 bp, Saccharomyces cerevisiae
actgcatcactattcaggagatgtataggccagctatgtaactatatagtgcttataacagttgattatcacatagaacgagtatgttaccctatggcccttttctggcacaacttcacaagagtatttcaattgaccaacgtgggtcttgttgaccagctgggatcacacagaccaagaactacctttattattaggaacatactgctttctggacacttccactgctataccttctcgcaaatagccatagttcaccaatattcattcggcccgttagacgcttgtaagaccactttcccgttttcgcccgagaagatatattagctgcttacattagattatttcatcaaaactcacggctttcaaaccaaagtcattggtgctctgctgcaattgccccatactacgcaga

SEQ ID NO: 14991 - DNA, 479 bp, Saccharomyces cerevisiae
aaaagttcaccatttctctccccagattaaaattacctagctatacatactaacctatgtatatatacacatatatgtatattatactctagaaaatatttttaccgttctaaatttctttgtcctttgttctatcaactctctttttccacatggtgcgttcacgcagaagaaaataaatatgttatttttttggtttattttctgcttatctatttacttttttactatatttttatttatttattctttggttcccttcggtttcgagttttcatcataaattatatcctccaacatatcactaactttactttccaacacatcttgagattttttatcttcactgatatacgaatctaaagctagtttatttttggccagttgatgaatcttttcctctatggaatccttagtaattaaagtggttatattaacttcctttgtttgtcccacacgatgtgccctatcagcagctt

SEQ ID NO: 14992 - DNA, 448 bp, Saccharomyces cerevisiae
atgataagattatatacgaggcacattgattctcgtattattgttttttctatgaactgaatatatttttaagtacaatatcaatgaaaaatatatgcaatcgagctctatcaataaaaaaaataagacagaaaaaagtggaaacgatactacctactccgtcttgctcttattatgtcgtctaatttaaattcgactgcacatcttgtcttaattaaagctagtgcgggccatgtacttcgttcaccagattttatccagtatggaatgttgtttagttgaccttcaataatccttgttaatgatagacttttcatccttggtaccacagcaatctccgtagctgatctgggagtcttttcatcaattattagtctttttattaatgagcacaacaggcctaaattatccaatacctccatcctatgtcgaaattccatagtggcaa

SEQ ID NO: 14993 - DNA, 404 bp, Saccharomyces cerevisiae
gtgtccgtccccgctctattatattgtatcgtgtcacccccatgtcatattatattcgtatgtatataaatagatcgattgacccgtatatatatatatctatataaccagccctgttaatactatactttactctctcctccctttttctcgttgtttgttattttggccccgaattattatatattaaggtactgttgaaaaataaaacatgtataaccttttgaatgaaaatagcaagaagtcggaagaaatctagcaccacatagccatcattatggataagaattcagttaacaaagatagtgaagaaaaagacgaaagacacaagattgaggttgtagacgatacaaatcctgacttcatcactgcagattcggaactgacacaagatctgcctgatg

SEQ ID NO: 14994 - DNA, 483 bp, Saccharomyces cerevisiae
tttttaacattttctctttttgtccctcttttcccgtctgtgacgaaacagacgattatacgaatctagttgtatagtaagatcaatatttattatataaatactgttgaataaataaaactctatctgcttcgtgcataaatttacaaataattccaaagaaatagcaacaagtaccagccttgtttagaagtacgaaaatcttggaatccacttttttctatttttaaataatttctctcaaaaagctattggtttgctgaatatttggccgagtaatagtagacgcactggaacttgtttcttcaatggatgactccgcagattcattgtatgacgatacgtatgaaaatctcccggattcgtgatccgccatcccataataaggatgtgctatatatataccgtctgaggaactagctctgtgtaaatctctaccattttcaaaggaatctcgtttgccctcgccgttggttgttactt

SEQ ID NO: 14995 - DNA, 417 bp, Saccharomyces cerevisiae
gctcgtccatgatagtaataagtactaaataaaagtaaaaaattgtatatagttcgactaacaacattacagtggtatcttttgatcgcgcattctatacttttattttgctactaattagatgtcgcagttttttttgtttgctttttgcgtaatacaaaaacaaacgcgaaaagtgttcatgtaatataatgaagtaaaccaagtctcacggaataaaatcaccttcttccaattttgtaaaagtttaaccaaagatccaaagtggcttgtaggaataatggattatagtaactttggaaacagtgccagtaaaaagtttcaagacgatactctaaacagagtaagaaaagagcatgaagaagccttaaaaaagttgcgagaagagaacttcagttcaaacacgtcagaattggg

SEQ ID NO: 14996 - DNA, 494 bp, Saccharomyces cerevisiae
ttggattgagaatgtaggtagaagtaaaatagaggcttgaacaccatagaatattttttacccgttactagtataactgttatttagtcgtaagcttttcatatatatattgattgttttgcccttgaaaaaatacacagcaccaatgcagtcctgtttgttttagtgatctcttagcaatgtattttcaaggttgaaaatttaaacgatcactattttgattgcgtaagaaatgcggaagtaaaccatttattctccacttccacttcaattttcttcttgcttccaaaaaccaattcattgatttagagcccattgcatctttattaaaatgatgtttgattgacttatcattttctagcaattgcaactgcaatcgttctattagttccttagagaagctgtcctttttttttgatatttcctttttaaggtcgatcttgttatcttctatgtgcctatttattttttttggaacatctgtcgataaatga

SEQ ID NO: 14997 - DNA, 475 bp, Saccharomyces cerevisiae
accttctaataatttgtcatttgactgacgaatcgttaggcacagttatatagttatatacacatagacatacatatgttcgcatatatattatattactatgcattcacctaaatagctactgctctattaatacagtgctttttcgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttggtatgtttattcgtataagttactgttgtccacaggcaatactctgcagaaaattaaaacggcattaatgctaggacaaccagaactgttactactgtatgtgcgatagttgataactgcaacattatgcccg

SEQ ID NO: 14998 - DNA, 455 bp, Saccharomyces cerevisiae
acgtgttctatgcggtttagatgaaagaaaaaaaaaaggtgttcttactttccatgttctgtatacgctcttttatatacatgaagttcataatgctaagtcataattaatagtttttatttttttgttgtcttttttttttgcgttcataggtatagaagggaatgtgcattcattatttttatctgttattgctatattattgtacagaaaagatgagagaaggaaaaaaaataaataatcaaatatgtatctttttttcttttactttgcttttaattgactaaaacccaaataacgaaaaatacaaagattataaaaaaaacctttgcggctaaccatctattactctttatcctgtcgaagtatttcaaaagttccctttgagcaccactaatgtttaaatcgatgtcgtctacgtttgcatcaatcctttggattacttcgccctgttc

SEQ ID NO: 14999 - DNA, 496 bp, Saccharomyces cerevisiae
tttcagaaggcttgcaaaaaggatatctaataaaaaaaaaaatgaactccagtagattttagatatcaaccataactggcgaaaatttgcacctttttgatgagagcatgttatgtcaaggcatggccgcgtgatggcattgcactcaagatagtttccggaattattatactccttatgtaaatttcaatccgtttatgtaattatatccaggaactcaatttgaccagacaagtaatggcgcccattttgagcgagagaacccatttttctatacaaatttcactagagcacggccgttacatttagtaatagccaataagggttttttatcgattagtgttccctgcgctccttaacatcatacaaccgagtacttgacatggagatagtaggcaagtaaaccaaagtcctttcttcaaaagtagaaaacttgagcacttatttcctgcgcatgtcatatgttaattttcctcaactgcgctgaatacgtcct

SEQ ID NO: 15000 - DNA, 439 bp, Saccharomyces cerevisiae
taggtgaaacatccactgaaaaaaacaaaggaacaatcacttatcatgctatatttcatagaggggaaaaaagaagcacaagtaaactgaatatttaagtttattttctatatcttttctatacttcatttcacttgtttcctcccttggttatttttaacgattctttattatgaaacaggaaaaaaaattattacaaaacagaattacatatttaatctatataactaacctttattccaaacctttataaatagcatctgctaatttaatgctcttcgaacaatttttaacgtcatggaccctaaccatgtcgctgccgaaaccaatacacgacgctaccaccgctccagtagcaaagtctctttgcttcgcatccacatcttttgtgatatgtccaatgaattttttgcgcgatggacccaataaaacgggcata

SEQ ID NO: 15001 - DNA, 400 bp, Saccharomyces cerevisiae
agggaattggcttaggggcgatatttgtatatatgtttttctgaactatgtttgaataaagagtgtatacagcattacataatcacacttacttccttgtatagtgcaagcaataccagtactaggcaacattggattacgaagtgccttctctttctttaaaaactaaaacgtagtccaatggtggtttcaaacaaataaatccgcacaactgtgaaaaaagaatgtaaattttaatgttactattctccagaggtaaataaggaaagcataggttttgatcgaaagaaaacatgcaatgtcgatcaattgtgcatcgtctgtactctaaggtctcccacgtaacgacgccaattttctatcccaatgccaaaccgcacctcggccatctttactccag

SEQ ID NO: 15002 - DNA, 498 bp, Saccharomyces cerevisiae
acataatgaaatgaggtgtataaattttacttttatgtaaccaaagttgtattaaatatttagaaatgttatactatttttgggttagattccgtctggcaaattaaacaagaatattcatcgggtttctgggccaagttttcgaggcaagtctggtgaaagccatggtgacatttgaatatgacaaggggagttttgagatctacactaatcatatcttggtggcgctgtacattttcccaagctagaaaaagtaatgggtccagaccagctccccatatttttttcccgcagatttcgcagtcgtcggtgtgtatagaccacccttcactcagaaattttctatactgttgaacaagatcttgcgaagaatcctctataatcttttgaatcaactcagaaagagatctttccaatttataagtattaaaaacattcagtagcagttgctttaaatcctgaactttcattaaaataacgtcttggtgctcaagaaca

SEQ ID NO: 15003 - DNA, 458 bp, Saccharomyces cerevisiae
acgcttaagtgcttgtcgggaacacgcaagtgtgcccataatgcgcataagtatatctttgtgtttacttatttaaaatgactaaataaataacccaaaaaaaggaagaaaaaaatgtaattattaagcattggaacacggtattgctgccaacttggcaaatcgcccgaaaaatgcctttattggtattgtattgtctaacggaacccagtgaatatcttccttgcagtttattagacgctctgttaccacttctaaatcttcaattcggtctcttttgtaaaaatgaccagtgactatatattctggaaagagagtgaaagtgtatctgtttggttcgggtgtggctttgaaataaacctccaatggctttcttctgttgtggtgggccgacgcgatgacggcaaggtctgtgacttggaagtgtacgatgcacttcccaggctgttccagataaa

SEQ ID NO: 15004 - DNA, 484 bp, Saccharomyces cerevisiae
ttagcatacatattgtctgtacataagtatattgtgtgtgcgttttgtttcactgagaaagcggacgtcataaacgatgcttcctttgtttcgagcccagctgcctaaatctttttaagggctctccatctacccaatacttgagagattcatttacttccactgagttagccttattgaatgcatcgatgtggttcgatttcagcaattttttcatccctaagcaactgggcaggtatagccctttcactttctccctcaattcttctaagacctttgcattgaacgcttcagcgtttgaagatggcatgttaaaattcttgcttataaatccgttctcgcacattatatcgtacttgaatggtttgttgaacatgaggcattcatacgtcgtatttgtgccaaacttcaatggcaaagagaccgttgtaccaccttcggtaattagtcctaagttagcaaaggggtatagcaaataaacctt

SEQ ID NO: 15005 - DNA, 441 bp, Saccharomyces cerevisiae
gcatggcatacgctgacttgtcaacccaatcacattctacaaaatttaatgaattaaataggtaattgtatataaaaatgtgaacctttgtgtattagtttcaattctatcttacttttcattgccattttacttctttcaccttgctgtctttcaaccttggaaatttttatagtacgcgtaaacaaaaaaggtaaataagaggcattgaatataagttggcatttattaggaagttgagtaataacacgttgaaactgggttaagacgatcaaaacaaccatgtctgctcccactatgagatccacctcaatattgacagagcatttgggatatccgcccatctcgcttgttgatgatatcattaatgctgtaaatgaaattatgtacaagtgcactgctgccatggaaaaatatctgctatccaagagcaaaatcggc

SEQ ID NO: 15006 - DNA, 410 bp, Saccharomyces cerevisiae
ccaaagtaagtattctgataaatctaaagagaaattactaaaaaaaagaaaaaaaaaagaacgggggtgtaataatttgtagttcattattgcaattatatatctatatctatatatgtatataacattaacatgtgcatgtacacacgtaatcgcgcgtgtacatgtctatatgtgttacttgaactatactgttttgacgtgtatgtttatttatctctcttctgattcctccaccccttccttactcaaccgggtaaatgtcgcatcatgactcccgacaataatcccctctggtatagcgagaagcaactttagcttcttaacggcaagaacttttttatgtttgtcgcacctgtatcttcacaaaagttggatacagcaataagaaaggaaaccacatttgtgcc

SEQ ID NO: 15007 - DNA, 441 bp, Saccharomyces cerevisiae
ttgtaatatttacgcttgcttatttcgactcttcctcgatattttttatctagagcatgctttcttttacttaaaatatttatggcaaataggaaaaatacatttggaataacgaactagttatgtaaaactatgcttattctcaaatagaatgtatatatactataatatattggttaacgtgtgttatgcaaaatgctttttgatgatgaaatttagcaaaagaggaggaagctttagcgaatttaacatatccttcattgttacaaaattgcctacacctccattgatccatgcagtccgattattgtagattttgagtagtcgatcttgaaaggcatttttgacgaattacaagaactcagcatcgatcaaatcttctacatgcgtatattgtaaaggaagacatcggctcttaagagaaatgaggcggacctgtaa

SEQ ID NO: 15008 - DNA, 475 bp, Saccharomyces cerevisiae
ttcctatagaatttatgagccatcgtttaagaaaatagtacaatataatgtataacttgaaactctatcttcttatattcaatagatgctactatgcgtacatatatatggtgagtgtgtgtgtttatatatgcgtagtaatcactcggcaatgtggaattgttaccgtgatagccttcatgcttactcttccaaccttcttagcaagtattccacctcaacttccttagtgataggtataacaatttccttataaatttttaccaaatattctggagtaatccttctttcacctgactcgttggtagggtccacaccatagacttcagccttcttagttaatctttctagaatcttttcttcaacggcagaattggtgatattcttcattatcccctcgacatctttacttttgatcagctttgtgtatagcgggatatccgattggaacttggcttcagcaacaaacttgcca

SEQ ID NO: 15009 - DNA, 426 bp, Saccharomyces cerevisiae
aagcatcgtctagtttattcttttgtttatgtacatattcaagaaaaataagcaagatgtaagaaaagtgaaagtatatattttctacagaacttaacaagtccctttaagcaccacatggaactcgactgcgcaaggttagcgctttacggactttattgctattctagttcaaagaaagcaaatggcgcagttaccaaacctcgccatttgttttttccgttattttttcttcttataaacgcgcctagaagaaaaaaccgtgcgaagcgcaaatcctgagaaagcgctaaggaggtttcaaccaatgtttaccacttgaaattttagcattctcatcactgtaagagagataattatcctgtaaacattccaaaataccttttgtaacgctgattgttgtatttgttaccccagaattgccat

SEQ ID NO: 15010 - DNA, 476 bp, Saccharomyces cerevisiae
gtaaggtgtagttttgcacccgtgtacataagcgtgaaatcaccacaaactgtgtgtatcaagtacatagtgacatttaaataatagcaagaacaacaataatagtagcgctactggaagcaccacgtaatagtggaaaagaactggaaaaaccgctataagatgcatactccggcggtcttacgcggagatacaagcttccaacggtgctaaaagcccggtttcggctcggccggaggaggaagagagacgaaaaaaaaaaaaatgactaaaaaaaaaatggaatattattaatgtgggatttttggctcaaggtgtggtggccccttttctaagggtggcgaattcttcaatgtacggaaaactcgccaaggctatcccatatataagcaaactgtgggttcatctatataccgacacataacacctaaagtggcttcctcctgcccctctctcccttttctccactcacccct

SEQ ID NO: 15011 - DNA, 470 bp, Saccharomyces cerevisiae
aagggagatgcttcaataacttttttcatgaaaaactatttaataaatttaatatatatacttcagaatgaaaaacaaatgaatagtttttactgaatatgtaagtggtatgtggaataagaaactcaaatgaagcaatggctatttacagatgttccaaaacttttcgcatttatatacatattgccttagcttggaggtaaacgatatatatcaccgttaactttcattctgtgtatggcaactttagcatcgtcctcgtagcttttcggtaatttatcatttggtttactttcaaacaaagatcccattaaaatcatatcattagttgtagcatcacacaaaaaggcaatatagtctacaacgtcacggtctaacgtctcagtcttcttagtttgctgattgactttaattagtctttgcttcgtatcaaatttgtaaaccaactgtaaatgctctaacggcattcc

SEQ ID NO: 15012 - DNA, 483 bp, Saccharomyces cerevisiae
tggacactttaggaaggaaaaagattatatataaaaagagttatactttttttattgattttagtatacaatttatgtacagcatatgtggtcatacatacataacatagctggaaacgtaatgatgaactaaaaatgcatgacctgttagcatgttttttcagcccctcaatgctcttagtctttgtgcaagtttgtcttccttttcgtcgtcaacattaacctctttcgcctttatctccggaacattgtccagttttgcactttgcttcaattccatgccattttcgtcagcaactttgctcattagttcatccaccttatcgttgtccaccagcatggcatccgaattcacacccatatcttcatatacgttaacactggtgtccaaatcttcgaattgctgttcgaacttgtccattatcatggttatctgttggaggttcatattctgtaacgccttatccatgcctttgcaaactt

SEQ ID NO: 15013 - DNA, 483 bp, Saccharomyces cerevisiae
tacatatattagtaccatgacgttatatatatatctgtgaagagaatccgtatctgtattatatatacgtatatacgtatcaatgcgcgtacaaaatgaacttgtctttttcttatctcgatttcaggaaaagcaaactattcaaggtgaaacggcggctaattttcctctaagttacttttattgtagtcctcaacatgtgcagacgaataaacttaacacggtttgcagagtgtgttgttgagtataaaacagtcaatttctgtggacctggccgtagcctattgctgaaaacacacaaaagaggagtttgacgagacttaaaacaagccaaggaaaataccatgttagactactcccttcattcgatggttttacgccgcatttctacacaaatgaatttacattcgggctgatatggttgctacataagcgaatttaaaatttgagaaggttcattgttgccttgtggttcgagcttaa

SEQ ID NO: 15014 - DNA, 426 bp, Saccharomyces cerevisiae
acggaattatttgtatattttagcagtttgattgtgaagttttctttaatacgtaggcaaattcttacgtcatcctttatatagtgaatgtaaactgctgttttacggtacgctaaccgtagcgaactgagactgtatatggtaaacagttagttgatcgtatggcagagaatctagttattctgaatacgttcccttcacttgagcagctcaaaatatacacacttaaacgcgatagaatatacatagaaacgtagaaacgacatcagtcgctttcgcttcctgccagaaggattaatagaaggggaagagccagctccgtagttagcgcatgcggaaagatgcccatactcaacagctcagttaaatatgacaggctagggctatttctgtaatagcaatgatgccatcacgtatgagagttcg

SEQ ID NO: 15015 - DNA, 437 bp, Saccharomyces cerevisiae
aaagttttcattgatccttctttctcattccttcatttaatgttcgttttatcttcattgttttacgaggatttttctgcttcagcagttccttgttcactaagtatacccatatatacccgcctatataccccaatttttttatacagtaacgaaacttttggtaaacgttttcaataatgtagtaatatagcccatcaggtattcatccactccactgggcattttctggagatatacgtatttatgtccctttttttctttttttttttttttttagcggtgggcttgaaaaattttcgctcattttcgcgaattgttgttggcgacactcgacaatttcaatttaatgtagctcttaaagacttgcaacggatagtatatttactaatttatagtttttacatttcgtacagaacttccttcgaaacattggc

SEQ ID NO: 15016 - DNA, 428 bp, Saccharomyces cerevisiae
gttattgcttagtttctgcgtacaaaaacgttgttctccctcctttatcttccttttccgctacaccaatatatcatgtttgttcgtaatatttctttttagacctaataataaatatcctaagtaactatattatataaaatattttgataccctgtacctgcttttgttatcgttgtacatccatgcacacgctcatatatatatatatatatatatatatgtatatgtacatataccgcttaccacctaccgtgaagtatatgtaagggtcttcgcacccggatatcccttgtgggatcttggatgcggatggtgagtgtaaacaggcctcataaagctgtctctgtgtgcggaagatgtcgtttcatcggcttcgacctcctccttatcttgcttcattgtttcttcgtaagagggcggatcta

SEQ ID NO: 15017 - DNA, 413 bp, Saccharomyces cerevisiae
gtaagcagtatataacgcgaggttcaatggcctctttaccatgaaaaaaaaaaaaaaaaaaaaaaaaaggtaaggaaaaagagtattttcaattcgtttctgaacatataaatataaataaccgaaaaattagcccttgaacataattaacactcttctttgatatttaaatcacaagtacttttcttttattttcttcttaatacttttggaaataaaatgaatgtgaccactccggaagttgcttttagggaatatcaaaccaactgtctcgcatcgtatatttctgctgatccagacataactccttcaaatttaatcttgcaaggttatagtggaacaggaaaaacctacactttgaagaagtattttaatgcgaatccaaatttgcatgcagtatggctggaacctgt

SEQ ID NO: 15018 - DNA, 435 bp, Saccharomyces cerevisiae
tttagtctatttaatacatttgacgttatttgatcttcacgttgtttatatatatatatatcaagtatgctataacgctaaaaaaaaatgctcataatactatgcaaaatcttgatgtcttttgacttctttccaaatttctaaattttgacgggcataatttctcatatatctggaataatgctttaaaatttctgataaatctacttccctttctttagaaaatttaggtagctggtcatttttgatgacttttgaaatgacctccaaatcattctcagtaacttccaatgattcagacagttgttcaatttctttcttcaaattgatacttgcggtatgcggatctgtttcttgatacttcacagaatcttttaccattgatgccaatttgttaaatccattgaatagtttgccaccatatgatttcccacc

SEQ ID NO: 15019 - DNA, 487 bp, Saccharomyces cerevisiae
tgattcccggcagcataacgacttttcccctgtttttattagtactagtagatatttaatttatgtatctgagtttttaatgttttttttccttctcttatcattcttcaagtgcggctatccttctgtactgtggcctgccgtcaacaacttctctgtagattatcagatccattcccttcatgtatgaatcaggtagttttgtggggtacagtgtaacgccgcttttcctcttgattgaccacttatcaactaaggtgttttcgataccattatagaagtctgtgggaaaacttttggtgatgatccagcagcccaaaaattctcttagtttccttagaatcttaaacagtttttcaaatttcgataaatttattacatcatagtttttgtcgctttcaaaattcaagaaagacaaattgtcgattactattcctcgtaattgaaagttgaaattatcaacctggcacctccttaacgcatccat

SEQ ID NO: 15020 - DNA, 423 bp, Saccharomyces cerevisiae
agaagtatgacttttaaaccagacactaatatattaaaatatttaatcttttgaatttttatataaacggttgccgtaattactatatatatattcaatggtaggaaaaaaagatgctgcacgttgtctgacatctgaagaagagtgctaatatgtagcttcaaaattttcggaaggcaaaaataatggttgctaagagattcgaactcttgcatcttacgatacctgagtattcctacagttaactgcagtcaagatattttcttgaatcaggcgccttagaccgctcggccaaacaaccacttatttgttgtaaaagttatacgaaaagaaccttttaatgaatgttttttttaacattctagccaatttccaacgtttatttgcgtatactcaacctatactatggcggaattcactcct

SEQ ID NO: 15021 - DNA, 415 bp, Saccharomyces cerevisiae
taaccacatcattacttccacagaatatgttttctataccgtaaatattagttcgtttatgtttttaaaataaattggagctattctttttcattgaattagatggtattttttatatgattgcaaactttgacgagaatgtactgctcattatttttcgtaaactgcaaaaaattgagcacaatataagtatctcagtgcattgtatacgtgtcgagtaatgaatcaaacaatagcattcttcttctcaattttacaatagtctgaaacaatttaatgacaagtttatcataattgtgttattattatatttatatttagaggcctatattgcgcatcgaacttttcaaaatccgcggaaaattatagaattcatcatatataatgaaggaactgtgttcctgaaaagaacaaa

SEQ ID NO: 15022 - DNA, 459 bp, Saccharomyces cerevisiae
tgaactgaactgaattatatgtacgaccgatatcctataaagctatgtatacagagggcaaatagcaatcatatcgcgcaataatggtctttttgcttcctggaactctatacgtacacatttagagattgaaagtggcaacaaatcttattatatgttaatttaaatacggtgatctacgctgccatcatagggctcattgattcattccctagctcttgaaaatgtcaatgaaattattacccgtctttgcaccttttttttttctaaggcgacgagttttccattggcaagacgtataaatagagagaagaagttccatttaatagaactattttacaaacatacttttagcgttaaaatatagttttttcttgaatttttttaaaatcctcatacttaccttaagatatcagaggagatcaagaagtcctactgatcaaacatgcgcttccaata

SEQ ID NO: 15023 - DNA, 500 bp, Saccharomyces cerevisiae
acatgagaagcattatttcaaaaacattgtttgaatctggatttttccaagtatctatttatatatacatatatatccaccaacatgcaaaaagttgttagcctttcttaatcctaatatgatgtgccaccctatcgttttttaccatttgcttaattgttctactttctcctgcagctcttttttaaccttaacccgcatataaaaaatgtcacagttcttatttgaacacaaaacttcactatgtaagttaccagcgcacctttggcattgtgtccataatcttgagtatttttcctctaaatctctgacatcgtataatgcctttatgtataattctccagaccttgctagacagtttgaacaaagagggccttcacctttcctcaacggacctttacaacttttacaagcctcaacttttttaataaagctcatcaagcctcctttttgagagcctgtgttaattttaatggatttcacaacgaacataccgttcg

SEQ ID NO: 15024 - DNA, 406 bp, Saccharomyces cerevisiae
ttggcatctagccccaatgacgatacactaatatatatatatatatatatatctatatatctgcaagaaataagcgtgtgtagtaagtaaaaggaaaaatagaaatttttgctcaaaaataacggtcccattttgatacaatgtttttggtttagtgatttgcgtaatatttatttttatttatgaaatgtgctttaggctttcttcactgttacaaataatttgcggaagtttctaaaatctttgttgaccttttggcatccaaaaacagcaatttggcttcattaacgtcattaacaacaatttccttacgattgcttgtttgtgctaggataccacatggtgccaataattgtaaagcgtaacgtaacgaagtttctgtacccatcgtggctaaaaggtccaa

SEQ ID NO: 15025 - DNA, 409 bp, Saccharomyces cerevisiae
ctttaaatgcggtactgtacattttataaatgcaattacatatcagataaatgtttattcttttaatattacaaccaaaaaaaaaaaaaaaaaaaaaaaaaaaaaaaaaaattggaaagaaccgatatacggtatataaaatcgagacaaggtccctttatgacttggccaataataactagtgacaattgtagttacttttcaattttttttttgttacatccaattctggctctggaaaaaatcgtatattctattcgcttttatggggtctatattaagtagttccctacatgcgcttttgcttagattacccccagtcttcaacagttctctgaacattacctcttttagaacgagatacggtttaggtaaaattttcagttgaatacaaagttgctgctcgtcg

SEQ ID NO: 15026 - DNA, 407 bp, Saccharomyces cerevisiae
accgcttaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtcccatatgaatccttgcagcaaagccgctcggtgttctttattcataagcaacctcattaatctatagtctgaaactaatttccttcttgagctgcagc

SEQ ID NO: 15027 - DNA, 420 bp, Saccharomyces cerevisiae
ttcataataactatgtaggctaggcgcacgatgtcttaacaattcagtgagtaagtaatgaataaccttgacagaatataaaaggtcgaagcatattgatcagttctgatgaactgttcgtatgaggtctaatttatgaacctgcgatagtagttgcaaccctttttttcttttagacaatgaaagtgaaaaacgataaatgtgatacattaaagaacattttgttggactgttgaaagacatatcacatcaacatgccgttaatgtccaattcggaaagagataaattggaaagtacattgaggagaaggtttttctacacaccctcgtttgagatatatggtggtgtgtcaggtttatttgatttagggcctccgggttgtcagttgcaaaataacttgattcgactgtggcgagaac

SEQ ID NO: 15028 - DNA, 427 bp, Saccharomyces cerevisiae
atagttaatcttggctagttgcatatttaaaaatcaggaaacagccttttagattgtaagcggatgttattctaattttttcttagtttctttattttattatgtagcagatggatagtaatatagtgttgacggctccgtttgttactcaacgctgaagttccataaggggtcgcccaaatggtgaatcaattctatggaatgacctttgttcactgatttaatttcttcagtacccatcatcaattcaccaatagccaatgcattctctttattttcggcattgatgactacaatcgtacctttctcgtaaccaggagcaggtggtaagtcggcacccgcagaagttaggccagggcacatgatattagcacctgagagaacgaatttaatagcacctctatcaacctgaacagtgggataagcc

SEQ ID NO: 15029 - DNA, 431 bp, Saccharomyces cerevisiae
tggttggcataataaagacgaggtaagttatgtatatttatacgtatgtatgtgatacaaaatgaatgaatattaagcggatggatcgaaacattttaatcctctctaatagaaactattttagacgatctgttgaatattcttttcctgtacttggccaaaacgtagaaaagtaacaataccgaaataccaagcataatctttggtaaaggatggtgaagctgattatattttgcgtcttctaactttctttgactaccctggtataaataattcttcaatgtaatacctttctccaaatcgccgttttggtaatcttgaagcctttgtaaatacttttcgtgagcttcctttgcatgctgaatcctgtgttcctgggatgaaatgtaacctattgttattggttgctctggtttgccattttcgtcagt

SEQ ID NO: 15030 - DNA, 476 bp, Saccharomyces cerevisiae
aacaatccctaaatatcatacgtttatatataaatatatttaatgtaacactcagtcactctctagcaacatatttgatcgatacctttagatcttcaacatttggtatagtggtttaccctcaaaacaagaatgaaatttgtatattaaacaaataaaaattgaaaacaaaaatagcggacttctaaatactaatgtgttgaacaacacaatgactaaagaaacgattcgggtagttatttgcggtgatgaaggggttggtaaatccagtctgattgtatcattaacaaaagctgaattcataccgaccatacaggacgtgctgccacccatcagtatcccaagagatttctcatcatcacctacatattctcctaagaatacagtacttatagacacttcagattcggacctcatagctttagaccatgagttgaagtccgccgacgtaatttggcttgtgtattgcgatcacg

SEQ ID NO: 15031 - DNA, 402 bp, Saccharomyces cerevisiae
agttcttgactacccctatctcacactagtacgtaattcaatgtatcattcgtattgtaagtagatagagacgcaatacaggaaagctgaccttccttccaatcaccacggctgaaatgctttgttgaccaattacggacgcttaagagcggacgcggctggaacggctccatcctaaatcggcggagggagaactccgataccagccgacatggcaataatagtgacagtagatgctaccagccccgcaataatttcacagtagatcatcaacagtctcctcatttctggaaatgatcagcaacttcgacggatttaactctcaagcagttacgcactccgagaacagccgtgatcatctttgaacaagcaaaatatataaagcaggagaactgtcctacc

SEQ ID NO: 15032 - DNA, 494 bp, Saccharomyces cerevisiae
tagatacagtgttttctatacatttatacgtatgaacaaaattataaaagagtctaccaacttctccagatatctacgaactggcggtgtactcaacagtcttcggaccacatctaagtttgtttacattaataacaattcatatttaactcatggaggttttgatggcaatgtagctactattttcaatatttcagaattcaattacatcaattcttcggccaaggggtcacttctaacttataaaagcattaccttcttttgtccaagatatttcaagaaacggcctttagggagacatgcgaagggaaaaggcaaatctgacgaaaagattctataaactacgatttccaatatacttaacacacaagaaatgtctgctaaacccgctactgacgatgccaaagatgaacttctatcaccatttcgccggctatatgcattgacaaggacaccttatcctgcgctcgcaaacgcagcactattagcatcca

SEQ ID NO: 15033 - DNA, 499 bp, Saccharomyces cerevisiae
tttacaccgctacggaatccttcatatatgtctatatatatatagaaacacacacacatttcgtttacttagatatgtttgtaaagtgaaagaaattcttactaggacaccaactctactggctctcatatgcagagagatatacatcaatacttgaaattttccttatccttcttcgacgcgtcatgaagagatagaatgcgtaaaacgcgtttgcttcaatagcatttcaaacacattatgttggaaaaaaaccaagaacagacaaacaactaaggaagttcgttattcgcttttgaacttatcaccaaatattttagtgatggatgatgccttgcatgctttgtcctcgttgactgcaaagaagagaactaccacctacaaaaaagttgctgttcccatactagatgagaacgataatactaatggaaatgggcccaatgacatagacaatccgccagagttgactgggaacgggtttttatttgccaatgccaca

SEQ ID NO: 15034 - DNA, 431 bp, Saccharomyces cerevisiae
atgtacggttaatatctttcttttatattatataaagacaccaaacctaagtagaataggtaactacgtcttctttcacagaagacagacctacaagtattttgattatcatgatgaagtaaaagcaacgataaactttttactaggtattattattctgcgctaacaataattatcgcgagttgaaaattttcaagcgatgctcctaacattactgtaaaacaacagtagatgagtacaaggcaagcttaaaaagaaagtattcaagatgggtaagagcagcaaagataaaagagatttgtactatagaaaagcaaaagagcagggctatagggctagatctgctttcaaactacttcaactcaatgaccaatttcatttcctggatgatccaaacttaaaaagagttgtagatttgtgtgcagcaccag

SEQ ID NO: 15035 - DNA, 477 bp, Saccharomyces cerevisiae
ataaatacaaagatgcgatgaagtagcagcatcgaatttcttagttttccctcttaacaactttttataagtatatatataagatacacaatcagtaattagcaaatgactactatttgtacgttctcatcgtcataagccagagtttaattaagtgcctcaaccgggatgcgatttcgcgttcatatacaaagccgaaatgacaataagaaagtcatcgccaaacaacacgactaattgaccattaaaaggaacaaaatacagtcaaagagtttagctcggaaatgtacagcaatcataatttaaattcggatgactgttgcttcgattggaatgaagagaaggccgcagaactacagcgtacaggtgtttcttttgaccggagtttaacacctcaatctttaagaacatctacacgtagactatcagaagagaacaaacaacaaagtggcactatgcacattgacacttcccctt

SEQ ID NO: 15036 - DNA, 407 bp, Saccharomyces cerevisiae
agcgtcgagtatatcaagccaagtgacgtttcctgagtataagaaaaataagcaaaataagtatacataaaaataaatacgaatagaaatatagtggcatctaaacaacccagagattttttgaaaaacacaatgagtatatactgatagacaaccacacggtctttgaaacgagacgccgtctacggttgtatcaaaatgtgtaaacgggccatttcaaagcttgatcttctccataattagaacccatgtcccgtggaagcgttttaaaagacatgaggcagaaacaggagtgtgatatccttgcatgcgcaagttggtaatacactgcacaaaacacgcgtgtgcacatacacttatgtggttcaccgtgccgctgctgtgtttatctgttgctcgacatgtgc

SEQ ID NO: 15037 - DNA, 458 bp, Saccharomyces cerevisiae
ttttgttacataaaactttgcttacgtatatatataaggtggagtattaatttcttgaaattttccagatttttatcttaccgtcatcaccgccagaagcaaacatttctttatctgcagggtttgatgcaactacgttacaatttttccccatgggttttgtggaattactcattaccgtggaatgaccggataaaacagatactaggttacctctaattctatcccaaatgtaaattttaccatcttctgatccgctcatgacaagcttattaccgtaggcgaagcaagatctgataataaagtgctgttgcttctgtccaaagtacttttgtatgagaatattttctttatagtcccacatttgtaattcgttatcttgaaggctaactaataccaaatgttgagactcggatatttgttgcctatggaagccttgatgcgtggtatttagcggt

SEQ ID NO: 15038 - DNA, 494 bp, Saccharomyces cerevisiae
gatctttactccaccctttatttgctcatagtacataaaactaatctacctctatatataatttctgttttttcctatgttccttttttttttttgttaaatggacatccttatgtattcacataactactgtgtttcaaatgtagcattatcctattctttattctctttttttaccgtattcctggttttttttcaaggtttagatgaaaatgaaaatgaaaaaaaaaaaaggaaagaaaacagttaaacaatcaataaactttatattctacgtaatcataagcgcttatccagtaccatgaaggtaaatttaatgttgaaaagagggcttgctactgcaactgcaactgccagttccgctccccccaagattaaagtcggagtactactgtcaagaatccctataattaaatcagaattaaatgaactagagaaaaaatactatgagtaccaatcagaactagaaaagagactaatgtggacgtttccgg

SEQ ID NO: 15039 - DNA, 483 bp, Saccharomyces cerevisiae
taatcatgcgtttccgcagaagcttttttttttttttttttagaatattcttactcttttatagtcaaacagcagaaaaactatataataatacatcacactgagcttttgcattttcgataactatcattctagttttcctctggtttgaattttcctcttgtctgtctgactaatgtcactcattatttccacttcgcgcaaagttcgtcccaatgcggaaaggcatagaaagataggaacagtgtggaacatggaaaagttccaaataacgtcaatagtccatacttaagatacgaaatttcaaaattccttcttttttgtttcaacaagcttagcctaacaccaagaatatacttagcatctcttcgcattcaaaatttctcttccattctttgacgttttaaatcatacctcgtattctttacacaaaagaaagatacctgtgaaatatatctgaatatggtccgattaaatcatgca

SEQ ID NO: 15040 - DNA, 426 bp, Saccharomyces cerevisiae
taagctatgacatgctgatacataaacatgtagtatatatactcattttatataatgtaattataagatatcaaccttataccgctgaagactttttattttgaagttttttcatcagtaatctggacatgacgatgctactggcacttacggccccaaaaggtgggaaatactccaaaacagttcttaatttactaggttggattttttttacaacactttcaatctgttcgtataagtcaaccaatgtgctgttattttgtaggatatagtcagatcttgccatcctttcttcagtgctcatttgactatttagcctgttttttgcatcttcttcactaagttcaggatttcttgtcattaatctttctagttgcaattcttgcgtacaaattacgcttacagtcactccgcatattgaatcca

SEQ ID NO: 15041 - DNA, 474 bp, Saccharomyces cerevisiae
gtattttgatcctcctgtttgcaacatgcccaaatgcaaggtaaagagatattagctttcacgaagtggcgtagtagcactattgtttaagtatcgtctgcacctgtgccttttggtatttggcactatcttaagcgcatgccaccaattatgctaaaccgtttcactttaagaaatttttatttaaatctttcactatgcaaatatgtaagtacttttaaaattctctttccaaagaaaaggaaattatttcagactagcagtaatttatcactttgctattcagatattaggagaacatccttatcgagcaaatctgcctcgcttgagctgacaacgtcatcttcgtcagtactctcgccatccagtaaatatgtgttttcattcaattcattgaaaaacggggttttcagtaaatcttctgctgaactacgcttttgaggatccatttcgaagcattgttccaaaacctgg

SEQ ID NO: 15042 - DNA, 445 bp, Saccharomyces cerevisiae
atcgaaatatctttaaaaaaaaaacttaaatgattatgtatgtatatataaaatagataatcattattattgcctcaagcattcttctatccattttttttttggttctttttaatattttataggaaacttttaatcatgttcaaaaagttgacagtatgagaatcgattgcatattaatatagcaatctaattgagatcttagcagaggtttgatttagttgttcataaatatctttaatatcgctttggtcaacagaagagatatcagccattaaataagcaatttcaccatttgaatcggaaaattgcttttcgatgttatggttcgataaaatatcattgacggtcttcaaaacacctggtacattttggtgaatgtataacacacgcacagtgttctcttggtcgtaagacaatgatttcaatgccacttctgggaagt

SEQ ID NO: 15043 - DNA, 474 bp, Saccharomyces cerevisiae
gtggtatgaaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgat

SEQ ID NO: 15044 - DNA, 499 bp, Saccharomyces cerevisiae
cctaatataggaaagggaatctttctccgtcagggccctattgacggaaaactttacgatctgtactgactgtgttagtttgcgtactcaattgaactatttcgagactatttagttagatacaataacatgtgtatgtgaattaattataaacgtacttttaaattgcagttactttgtataattatggtgatttttttagtacttaaattatattcataaaaagggattaaaatgtttctcccgacacctaaaattaaacttcaatctgtcaattctaacacaaaacgttttcattttacgtaaacaaatgaagattgaagattctaaagcatttattattactgccgcactagtatacgaccaaactaaaattatatgataatagtgcaccaacatatagtaaacagcttttacctatgcacgacttgcatgaggatttcaatattatatcactgtagacgaaatatgaaaaatttcagcaataaagctcatcgca

SEQ ID NO: 15045 - DNA, 462 bp, Saccharomyces cerevisiae
tgtcacacaattttcaaaccactttcctatgtatttatacaacattggatcaatgcccctttattttaagttatgtattttttgttgtcttcagtatacctaaaatttaaagtttttttccctatgcagtgatttttatctatatattttacttttcgttaattgaagagaggaattcattccataagtcctccttaactttgaaagtatgagtacctctctcaggaaatgtcctatcctctacacttgcaatgtactccttcaagccctgagtggcaatatctgtcatatttacagcttgcttcacaaattttgggacagaatcgccttgcatcccgagaaggtcagatataactagaacttgtccactggtaccgttacctgcaccgatacctattgttggtactgagagtttagatgttatgaactgagccatcttatgggggacacattcaatcagga

SEQ ID NO: 15046 - DNA, 420 bp, Saccharomyces cerevisiae
acggaccaaataacataaatttagaaatttccttttttttttttttttccccttgactttcttttcttttatgtacctataatgaaagactattttataattagagctatttaaaaattattaatgaggttgatgagtggatagaatattatattttgaaagctaaattatttcatcaacttgtccgaaatgtgatgattgtctatgtgctctcgcactaatttggcttgttactacatgcagatcttgtgggttcgaattttgccattcccttaatttataagtttgaccagatagatcccagtaaaggcctcgcaaagtggtatatataccatgcctaccttcccagagtggataaatacaaacggcaaacgcactgaaaaaaagccagatgatcatcacaacaacccaaccggtaaa

SEQ ID NO: 15047 - DNA, 403 bp, Saccharomyces cerevisiae
tgatggaagattagaaaacaaagatagataagaattcgttttgtagcatcctaaaatttacttctattgaatatatacatgtatttattacttggacgttctactttaaatgtagtcagtcgtttttttctcgatattgtttttttattgtttcctaataacttcatttgttacttttttgccttttgttatttatggaaataatgcaggttaacataagtaaacataaaatatgagaaaaactaagaatgtttgctgatgtattgaacagttcacatcgttgtgtctactattaacactaagttgttgatcaaaacattccctaattaatagctgccccaggacttggaaggccacactactctccatgacatcaaagatacggcccaaataatctgtatcc

SEQ ID NO: 15048 - DNA, 483 bp, Saccharomyces cerevisiae
tctctaaactttgctataccttattcgttgttgataagtacacttgtcccatttccagaaatttaattattcaagtctttagcttcgatagacgatgtacttgaaaaatttataatcgatataattttctcttctgattttttcactctttttttttttttttgtactatagtaggatactcagggaaaaagaaaccactgcctttgaacaatgttgcgaaaccaattgattagtgggctacaagagtgtaaataatgaagatctttcattttttgtaggaatgcgtttactctggcgtatcttttgtaaaggtttgtttcaccgagaaaggaaaaagctcggcaattggtttaatcttggttggattgtaaaaaaatacattaaaatttaggttctaccccgcagtgtttgcttaatttacataggacccttttcctgccgtttttgttttgtaagggtgaggaaaaactggggacgatgaa

SEQ ID NO: 15049 - DNA, 460 bp, Saccharomyces cerevisiae
agtaggtagtatcgtttccacttttttctgtcttattttttttattgatagagctcgattgcatatatttttcattgatattgtacttaaaaatatattcagttcatagaaaaaacaataatacgagaatcaatgtgcctcgtatataatcttatcattatttagcgataaaatagttttgttgactccttctcattcagatataggtattcattttcaacgacgtgtaggcttgtgtttgaagttgcaatgggtgcgccgcccctgcaaacgtgcaatgagccggttacgtcctttgcaaaaccggtcttcagaggattcaagttcaaattaatcattgatttgataaaggaagatttgtagaaattttgcagattcgaggaatgaacagaagcatcgtattcatctatattaaatatgtccgaattggaaacaatgattagcactttgcattgcctca

SEQ ID NO: 15050 - DNA, 419 bp, Saccharomyces cerevisiae
tgcacaattgttttccttcacctacaaccccacccctcttcttggggaaatcattgtattacgtacttttttcctaaagatattagaaaaaaaaatgttatgtatcaatattactaggtaaaatacaaaaatgcgcttttgaagtataaataatacagttttgttttaagaaatgctatatatgaattaataataaatgaaacgaaaaaaagcactacttgagttttaatgtcgtaaaacttgagaaaattctaaagtgtcagaaaaaaagtgatttttaagaagggacaccttctagctcggatttagagattttattgataactcttctccaattttttctattatcataaatggggaccctcaatacactcaagtaaacgacaatacacagtagggcaaaggaacagactgacgca

SEQ ID NO: 15051 - DNA, 415 bp, Saccharomyces cerevisiae
ttgctatgcagatgctttatacttcttttttttgtttatagaaatacgaaaagtaatgtacaaactcaatgtgatgatgtgcccaaaaatacaatcgctgatagtgaagctaccattactgctatcccccagatgaatagagataaacttaagtatttgaatatttttatgcttgtcggtactctttcattcgtgcccgtaaattctgagccaattaatttataaccaaaaaggcctggcaaaatgaaagaaatcgacgtagatcccgtggcaccaactattgctaggacttttgctagagacgtaattgaaatagccagtagatatgagaacagtaagatacaaagggtgataatattgatatgccgtaaagactcactacgcagatttggctcttcgttgttttgttgggttg

SEQ ID NO: 15052 - DNA, 418 bp, Saccharomyces cerevisiae
cgcacatagaattattggtcttgaacaagcactaattttccaaagatgttttaactgatcttaatttatatgtagaggatatatgtagtatatctattttttgctgattgacttatcaattagcttcataatacaacattgtttttgtttttcgttactcgcgactttcttcgcggcagagccgcgctacaggaaaacaagatcaaaacatgcccctattggaaggcttaaaaaatgcttatcccgaacgagccaacggtaatcaacactatcgtcataccaacaacagttgagttatttttcgctcccatactttttagaattggtttgtttgtgtttggttaaatttcaaagcctttatattctttgatatagattactctacaatttctttgtatacagcgggaaattgacactt

SEQ ID NO: 15053 - DNA, 480 bp, Saccharomyces cerevisiae
ccatgaagatttaatttgctttctatagatacgtatgtatactaatttctgaaaggatgtagaattacaaatatgatattgattatttttttctaggctatatgaatataagatatgcgatgaaagaaaaaattatttaatttggttggtcctttttagccaaaatgagtttctcagcattgttcttcgaaactatatctcgatccaattcttcctttacagcttcatagtatttttgtaaactcctttttggcctataaaaagtatgatcaattttgagggctctaccgccaattttaaatccatttaaattatcgactgctagaatcgttgaccgttgatcctcatatttcaaatatgcaaaaccttgcgattctcctgtgttttcatccctgctaagaattacatctacagggactccatattcagaaaagactgtcaatatgtcaccttctgttaattctcggttgagatttccga

SEQ ID NO: 15054 - DNA, 472 bp, Saccharomyces cerevisiae
gccatatgatgtggtttgtatagatatatacatagactatccatagaaatcacccacgcattacccgaaagttttcaataaagcgaacagcgagaagaaaaaaagcgaaaccgacagagaattaccaccctagagctttaaccccattgagatcaacacaatttcgaacagtgaaagtgcattggcgaaggtgatacaattggcttccagctctgaataataataacttacaagcgcaaagataacagataattttatatcagcatacaaatggtcgtcatagctaatgcgcacaacgaattaatccatgacgctgttctagactattatgggaagcgccttgcaacctgctcttctgacaagacaatcaagatctttgaagtcgaaggagaaacacacaagttaatagacacgttgactggccacgaaggcccagtttggcgtgttgattgggcacatcctaaattcggaa

SEQ ID NO: 15055 - DNA, 457 bp, Saccharomyces cerevisiae
ttggaataaactagctcgactttaacatagatcatacaaaaaatacaataaataaatcctgtgtttcttttatgtatattttttatcaatttcaatttagtttagtttagtttctttaaaaataaaattgtaatttctcacattctgccttcgggtctcaagggctggttggtagacgaatgcgcttgtttctagctgagcggcagatgcatgaattcaatgcaagaaaatgagaaaacttccaatattaaaatgtgattgttaattattagtatatttatgacaatatatatatgtacatagggtgattatgaagatgagtaagatgcgaatggatatgaggatatgaatctttttagagacaatgaagatgcaaagaagtagttaagcacattgacctcagggttgctatatgctacttttagtccgttggatttctgaagcagtattggccaca

SEQ ID NO: 15056 - DNA, 445 bp, Saccharomyces cerevisiae
ctgttctaaggtatatcaattttaagtataattgtatataaatctacttgcattagatgcctctataaaataaaataaaccaaaaaaaaaaaataaattgcaccccccgtaagttctcatttacgtaaaggttgggcttgttgcttcttttgtttggcaacagcataaataatacctgataggaaaccaataaaaatggagagaatagataagaagtttcttggagcatcaaagaaaatcaaaccagacaaggcaattggcagcttgttcaaagcccctaccatcgaatatgtagtagacgaagtaacacgaacacaccaaccggaacagtaagaaataccgacggatgcaacaccactgatgatcatagcagttagcgaatcgttagaaaagttattggtcaaattaactgaagaccaatcttccacacagaaagaaaacagca

SEQ ID NO: 15057 - DNA, 464 bp, Saccharomyces cerevisiae
taaggacgcaacggttggaccgttcctcttcctatggcctaatacccatgaactattgattatatagtatataaaactcaccatggattatctattcatggttcgtaaccaaaagctaaatgctcatcacattctaaagatcacaaaataaaatcaacacgtatcaagcgactaaattgtagctaatttttttctttctttccagggaaggcagaaagtgtgagtgatgtttgtatttctgacaagctgttgagagcaggcaaatggtgcttcatcaagttaaataatcatcgttgaacgacttcaaattaacagcggcttgttccttcgttcccttcatattcatcactgagcgtagaaagctaacgtattactcttttttttggaaagggagtcaattgacgcttaaagactagtcattttgtttagaaaaagtcttatatttatttctgcaggtggcaaca

SEQ ID NO: 15058 - DNA, 400 bp, Saccharomyces cerevisiae
cttgaagaatgataagagaaggaaaaaaaacattaaaaactcagatacataaattaaatatctactagtactaataaaaacaggggaaaagtcgttatgctgccgggaatcaatggtatttatagccgcattgtttacctacgtgttcgttgagccaaacgtcaacgttctcgaacttcaggccgcaatgcttacatctaccaggaacaacatttctatcctttttcttcgtgcctggcgggtattcaaaatgcaaagcctttaaatggtttttgaaggtgtcgcaacgtgagaacacccccgtctggtgacaattggaagtctcaaaatttaaaggtttcagtttatacgggtacatatccatgtccaattgtattaaggtggagttgaatgggcactt

SEQ ID NO: 15059 - DNA, 429 bp, Saccharomyces cerevisiae
tgaatgtaacgattgtataagacatggagcgtataaagtatatttttatgtaaaatgatctttatgatttcttattttgtgtggaatatagtcaaatgtttaacgacctaccattatatagtctgtctcaattaaaatccttcaggaacaccttttgcaggtctttgacttaaatcaaggtaaataccgccgtttttgaacccaaaccacttgaatctcacttgatcgtcactatcctcatttgtcgtttcatcacgcttgatatctgaccttccctcctccttagaaataggatcttgaatccgctgaataattttataagcttccacatcagaataaggcacaccagtccttggatcaaagtactgacattctttatttgtgattaaacatttttttcttataccattggctaagaagacacccgtt

SEQ ID NO: 15060 - DNA, 493 bp, Saccharomyces cerevisiae
taactgtatgtatacgtgtgtgtaactagtaatgaattttcaccctgtggaagttaggcctatttaacaggaaaaaggacaggattttaaatctcgtcttgctcttcttttaagaaatatttgccgctaccgtttttccaccatctcatcaaacaactatgtggggttatatctatgacactttcatcatcgcttttgcatctacacctctgatcgagcctaacagcgtaagatgctggacaggtgccaaacggtgagtgaaaatagccaagttcgtcaaaatgaatgatttcgtcaggtctcagcagtagggagacaccaattgaatgtacaggtgcgtcaccccacctttcgtagtaaaatccgcccttggcatctaaagtttcaaaaaaatgcttatattcgtcacttctgaagaaattcaagtcgccaatctcaaaattcgaccaaaaatggcacaaattgtagtcagagtttgcttcaacaacgggat

SEQ ID NO: 15061 - DNA, 500 bp, Saccharomyces cerevisiae
tcgaatgtttaagagggaagagctcttcttacgttaaccgttatatacatatatatatatattgagcactttatattatcggtcagtttcataaattcgtggctatataatattaattaattgatgaaatgaataggtaggagtttggaaagaaaatttttaagcaaagtcattgccaaacaaaaagtcataatcaaataaatccaaacctccaaaataacctggaaaaggagtattattcgcttggcctctatcgaaaccattaggaagttgtgatccagatgagttatcgacaattggtgtagcattgattgaattgttcaagttattcatcccggctattggcgtttgctcttttgaaccaccacccgccaaaggaccctgacgtaaaccactgttgtagtccaagctctgaccaactgcagcggccgatgatagtttttctaaattatctaaggatgaactccatgtctttgtgaaggtaggaacagcatttccga

SEQ ID NO: 15062 - DNA, 493 bp, Saccharomyces cerevisiae
ctgtaaccccataactatacccgtacgcagtactaaaaatgtatgtaattagtaaatgtatgtaacaatttcaccgttttgtgtaacaattcattcattcattcttttgatcctttagtaccgtccgcacatgatgtcatttccccctcatttttgtttgctggtatgattccccgcccgggcgacggtacggctgttatccagcgatgcgggacttccgtccacaggtatctttttctccaactccaacagagatggaaaatgaggggcgggtgtaggtaagcagaatgaggagaaatttgtaatgaaaatggaagttcggcggttatataaatggggggggtttgtcggtgacaattgacttcactctcctttcctcaaaaattcttgggtgttaggattagaagtatctggaaaaccaaccaagaaaactacaataacaaaaataaataaagcatgttcagtagatctacgctctgcttaaagacgtctg

SEQ ID NO: 15063 - DNA, 416 bp, Saccharomyces cerevisiae
gtcaagagcgattgtaacatcgtaatcattaaccttttttgagttactttgattacttctttccttttctttccacttcttttgtataagttatcataattatttttggtattactatattatgtttatcattaaatattggcgatataataaaaaattctagtcacaagtactgttggcttaataagtttgccaactaatgtttagtgatgatgatgaaatagtactgccctgtttattgccatttttctatgcaaaatgtacaataatcatttagaacgagtagttctcttattcagaaaatttttcatctcatctcatctcatctcatctcatctcatccatttatctaccattgtttaaaggtctatgtattgtaaaattaaatcttcgtagcaacgcccccattattctta

SEQ ID NO: 15064 - DNA, 498 bp, Saccharomyces cerevisiae
attgctttgcgtgaaatgtatgtatgttcgctttgtagccgtatattatttttttattactgaccttgcattttttcgtcattttcccgtcggtccgataatgaatcatcacgatgaatgactaccccataataatgacactaattggagcgtataaaagaaaaaaattatataaatgtgtttgtaatgagtaagagcaattgattcatttgaaatgaaaatcaaaaatcaaaattaaaataaaactaagcaaccatgtcaagcggcagtactattgtttcgtctgacaagtcggggcgaacatttaagcatgaggaagaactacccaagttaccattacctaaactctgtgacactttgcagcgtctgaaggagagtttagagccattgtattatgctgatggttactatcaacatcctttagatccagaacaaattgagaagctgtcatccataataagagattttgaagagaatcccgtaagtgagaagctgcaa

SEQ ID NO: 15065 - DNA, 462 bp, Saccharomyces cerevisiae
attaaataaagatttacaaaataataaccttcatttaattttaaatttcaataaaaaaatatcaaatcaaacatgacttttaaatctaccattagataattgtataaagtgatttattgttttttaattttgttttcattatctatcaaaactagggcattcttcctcacttttagtgataaacttttgtaaactcagtagtatatccagccgacgagcaatgcgataacggtgatgataagcaatgctctggaactcagactttgcccgttacctgctgatggcgctcttgctgattctgcatcgtggtttccagacggttttcttttcggtaacacggagtgaaatattttgatcttcttgaagactatgtcatctttgtactgctcttccagattaggccaatcggacaacagctcgccatcctccacgttttggtaagctgccgggataggaagtgta

SEQ ID NO: 15066 - DNA, 437 bp, Saccharomyces cerevisiae
aaacaccctagaaagggagagattttatttagcgaatataatttatatattatttccgtaactgaatttgtacttttgaatgtttaactgatatctagagatatcgacatgggaatgccctctcaaactagaaaagggcagagaacgaaaagaaaatgaaacaatttgttacctactatacagttgttggtcttgccaacacaaatatgaacatatatatatatatctcacttgatgaatccacgtatcaaggacaaccttttcatggaaacatatactgtaaaacaaaaaactctatttgaagtccttatgtgtccacttttcagtgattttctgcttatactttctacctttcctaacgggcactcttgtttcgaccttaccagaactttgtagttttctcacagtatcatatagcagatttccttcaggtttca

SEQ ID NO: 15067 - DNA, 466 bp, Saccharomyces cerevisiae
gtcgaaaactgacatacatagtacgtatatatttatatatgtgtgtgtgcgtgtgcatgtgtgagtgagtgtgtgtgtgtgtgtgtgtgtgtgcctacctgcatgtatgcatttagcaattgatttttcttttttttttttggaagctttcatagtatgaattcgcattttatcgtgtttcccgtatcaatcttcaggaaacataattgaacatcatcgatattcaatggcagtagttcatctttatgattgtaaattttgacaccgttggaaatcgtaaactttcttgccccttcaccgccctcattcttaattatatcgcgatatatttcgcaatctttaaagtagtggtaaagtctcagcctcaatacacgcaaggtagtaccaaactcaggtcttttttcattttcataatcctctggagaaaattcaacatgaaattttaatggggtggacagaagttctt

SEQ ID NO: 15068 - DNA, 448 bp, Saccharomyces cerevisiae
gaatcaggtttcattcccacttttgttaaccatgaagtttttagtatgtaaactaatttgtctttttatctaattgtgactatatttttataaattctccagtgatcgtactacgtcgggggcgtatttctccaccattgcaagaccttgcttcaacaaatgaggtttaaagcttttaacgtttgaatcattcaatgctactgatctgataggtgatgtaatcttaccattagaccaggaaatgattaggccattattggccacttcgctttcgttggctgcagggtccaatagcatattgttgcctacaacggccaatataaacactaaaggcggattaatgtcaagcttaaccatgtcgtaatcatgaaacgtaggaagttcttccacctctaagtcgtcaaaagctgaaataagtttcggtaggtatgtggagttcaacgctgaa

SEQ ID NO: 15069 - DNA, 484 bp, Saccharomyces cerevisiae
ggcctgacacaattttcggttcttttttttctatagataatggttatatgttatatttacggatatttttacgtttactttgtaagaaagagctaaaaagatgtaaagatatcacttcgtttttttccctcaaaaaataacttcccaatcttcagttatgtcaagcgataggttaagaatggtgatcttattatcattctcatatgacgatctagtcggcaatgaactttcttcgccattttttttgactttaatactgtctttcaacgttatgttgtgttgtaaattattctttgcgataatgattttttcaatattggtattcctcaaagtattgtggtgaatgcctgtcaaattctcgggaatatgacttcgaacattttttaaggtattgttttcgaaaatgaactgagtttctacgtactcacctctttggtagccaaaagtttctccatcatcaacataaagatctccaacggctcgt

SEQ ID NO: 15070 - DNA, 481 bp, Saccharomyces cerevisiae
gatatgctatgaataaacatcttattataaaacattgatatataaatatagaataagaagaatatactataaaaaaccgtttgatattacaattacttcttcttccttttcttttatttctttgaggaccattaataattgagaaaatggaacaaatagaaaacctttttttcttttcgtctactccttccccatcacatttttctaaattcacttagcacagggtatatagcttcaaaagcttggtaaatttcttccctttgctttgcaccagtaagaacaatctttcctgaaacaaaaattaacaacacaattttcggcttcaccattctatagatcaaaccaggaaacaattctggctcataggaggagaaagtaccatgactgaatgctaacccttctagacgtatagggaatttaacgtcacacgaaccgacaatattttgtattttgaagtctgtgaatttagcagcaaacccga

SEQ ID NO: 15071 - DNA, 499 bp, Saccharomyces cerevisiae
attcaagccctctactatgttttatagttgacatatttgtatataaaaacttatacattattaaacatttgcgcgtcgattgacttttatttattattaacaaagaagtaataccaacctaattacaaatacttcgaagtgactatcataagtttccttatctagcgaaggcaacttttgaactccccagttgttaatatgtatcattatacacgacccaatcaaacgcggggaagtcaatgccgaaagaattctaggacctaaaagctgctcaatccttgggcctttccctaatgacatcccctctcaaactttagcttagcagttgtatttaatgtcctgtcacggatagtcaataatcgttgaaggttgattttcatatccttcgcaatttcgtaaagcaacaatagcaatacggactaaaatggtatgttggtgtgtgtgtgtgctgcttcacatttcaggctaaaaatgttatccgtggaatcttccttagcca

SEQ ID NO: 15072 - DNA, 450 bp, Saccharomyces cerevisiae
gtcctcgagtgagataagaatataaagtaaacaattacgtaaccttagaaaaatagatataaaaaagttttacactgtttttaccacagtccatataaacttgtaattattacccgaatgctttgattacttcgctcttttaaaaaaaaacccgttcgaactattaaacatgttactgtgagcagacaaaaatattgcaagaaaacagctttataaagtttaagcattactgaatacagtacatttacttttgaagaaggaaataccatctagcagaaatgtcagattcagagggaggtctagcttccgaagttgaacatgagaagcggtcaagatctactagcaacagacccaattatgcaattgatactgaggatttagatattgatgaaaatgatgagaatgaagatgatgattacagagaagaagaagccaatgagggagtgaatg

SEQ ID NO: 15073 - DNA, 425 bp, Saccharomyces cerevisiae
agatattaaggaattcgtagctccaattgaattttctcttttgtaacattcttctggttctatatatctaggtttatattttgatgtgttgtactttcaattacattgaacttatgtatattttttaattaataaagtgaaatcaaaagcaaagtcaaggttgccgagtaaacggtttgtatggtatttctgtcgtatatagcagataatcaccatatatatatatataccatggtgatagtctgtagcttttacaatgcaaatggcggcgcacgactataatattcagaaatagtaatttcatcatcttttgcttctcttgccgaaatagatacttttttcgcgatcaccctacgcataaaaatttttccaagtgatgagatgagcctttaacaaaaaaagtgcagtttgatttcagaagggtc

SEQ ID NO: 15074 - DNA, 485 bp, Saccharomyces cerevisiae
gatcctctcctatgcatgtacgtatatatatatatatgtgtgtgtgtgtgtttatatacacttatattttgatccttgggcctagaaataaatttcgattcctatttcgattcctatatcgaaaggtggttagaagctaaccggcaactgcagcatgttcttcaagtggtgatacaaatttaaaaggccgggtaaatattgacaaagaaataatatttaatcacacaattttgagaaagagcaactgaatcaattactctagagaaatcgcagaacacttcactcgtcgtcaataatatgactcgtgatacacccgaagatgtcagtactgcaggcgcaaaggatattttagatgttttgaacctactaaaaggaggagaagagaaaatctcggaagtcgaacttaagttggatgaaatggaaaagaaaatggactctctgttagttcagttagaagatctacacagggacaacaatgatttggc

SEQ ID NO: 15075 - DNA, 426 bp, Saccharomyces cerevisiae
aaatgacaatagacttttagggctttaagaagagtccacgaaagcacttcactatcataaagactatatgtaccttgatcaaagaaattattgtcaagattttatagtaagggtattattttgaaaacggagtcacctgttcttttatatacacacttatatctatctatatgtcgatgtacattcttagaacaaaaatctgtcggacctttactgcggcattgtgacttgaacatggaagctaactcccttgggaaaagctgttttaggcctatctgttggcctgtcgataaaagacgccaagcaaatgacctcttcagatgaataacctaaggaagacaacacgcctctaataattcccacaggtatctccaaaaacggttctatcatttttaactcctcgttttttgcatcttcctccaaaga

SEQ ID NO: 15076 - DNA, 415 bp, Saccharomyces cerevisiae
tcttttggttagtgcgactgttcaatgacttaaaaaaaaagaattataaattattctgtgccattatataataatatataaaacgaaaacaaataatggtgctctataaacattagaggacaatgtcaatttcaatgtcaatgccttagaaattaaagttggtaagaaagaaggaaagggcaacctaattagctgccgcttccggttgtacttcaggttcgttgctctgagtggtgctggatatttcagcctttttactagcagcttcctcctcttccattctttttctttgcttaatcttcttattgctctcgggcgcatcagtaagacctgggatacccttagctgtcaagaattcgaagatactcttttgcacagcaggtcccgatttatcggcagtttcttctccctgtgc

SEQ ID NO: 15077 - DNA, 441 bp, Saccharomyces cerevisiae
gacaactgataataaggtgccatatatacgtagatgtgtagatgaaattagagaaagcaaatagacatctgaatcgtgctaaaaattgtaattattgtgaaaaaaaaaattctgtattcgcaatttttttaatgaaagtcggcagccggtaaatatgcatataatcaagcgttttaatgtgggtctgaacaaggtatttctgaagattttttcttcacatattccctaatattttagcgaaataggaaaccattggcaatggaacaactgtgtaagaggtacgtgcatacaccggcggcttttatacaaaacattgttgctaacactaaaagaacaacgctagccacgcaattatctgttgaaaaagctaaaaaaaaagttcccaagacagctcttaaaaagaaacttaatagtaggccaaaagaaaggcttccgaattgg

SEQ ID NO: 15078 - DNA, 431 bp, Saccharomyces cerevisiae
atataattattttaacgaacttctataataatatatatgcaggtaaaattataatttaactacagtttcataagtgcatttgtattgagcattggttttttattcgcatatttatatcttcattgcggcaatcacccagagaaagggcgtgaaaagaaaaaggaatacattatttcaagttcctttgatctttcctataatgtagactttcttggcgcaagacttggatgcatcatacaaaatacaaattgttaagcaaaaaagtgtcgctctgctgtaagctttgtgatgttatatttgatcgtatggtgaggaaaaacaatacacctcatgttatataatgatcgttgttttaggtgagatgtggaaatagaagagagatttttaaacaaaaagtaaatggttttaaacgttggcaataacaaggcctg

SEQ ID NO: 15079 - DNA, 413 bp, Saccharomyces cerevisiae
aggatcttccatccttcattatatatacatacctatatacgaaccgaacgaacagaaagagaagagaagacgcaagacaccaccagaaccaagagcatacaccactaccaccaccatcgctaccaacagcaggatatccggatgcagtttgacgcttgaagatggtattcacctcaggggtaaacgcgcagaaactgcgcgtttacctgcagcgacgccacaaaaacggaccggcccggccagagggtgagaccagcagcggccccgttgtgaaatctcacccccagtcccggatgggcacgagtccccagcgcccgtcccatgaggtcctcctaaggtagacagcgcggatgtttccgatgcaaaggagaaaggatggacggtacagacatcgtagacaggattcgcgcatt

SEQ ID NO: 15080 - DNA, 465 bp, Saccharomyces cerevisiae
atatgtatttgctttaatgttgccacataaagttgcgttcctttatagaacaatgttgcctagaccccatttcggggcaggggggaatctgtatcatggccttcttacaaggacagcttaaaatgttcatgttaaattattcgactttttttatgtatatatgcaaagtagaaaaataattagtaaacatatataggtaccttttagcttggcattagaatggaaaccaatttttttatcagagaaaacaaaagaaaatataaattacacctcgaagtaaacacccaaattttgataaatagaattgaagaaataaaaacttagccctcattaacccgaacacatttcacaagcttctgggttatcaatagcacatgctataaccttagagttgtaaatgtcgaactcggtttcctcatcatcaacgatgggggcagctttttcttcattcttagttggggcagg

SEQ ID NO: 15081 - DNA, 433 bp, Saccharomyces cerevisiae
taaaaaggaaatagttgtagaaacgctaagacgaaaagaactctataaagttgaaacgagtacacacatttataaatatatacaaaagtaaataaaaaagtgactgtttttatattgcttattgccatttgctatttccgtttcattcttgttaacattggaaactttgggcaatatcatatggttgccgggtaaaggaaaaaacaaacaacatcgctataacataaaattggacattgcagagagtcatcaatcacatccattttcacaagaaagaggtgttccacctggaataacaagcttctctttccccttagaatgacatctaaagttggtgaatatgaggacgttccagaggatgagtcccgcctcacagaagagaacgtatccgtacctgaagaagaagtagaagacgaagacgaggaagaagacg

SEQ ID NO: 15082 - DNA, 487 bp, Saccharomyces cerevisiae
ttttcctgccgtgtgtataaagttgcatgtagtcagtcataaacaatagcagccagtgtaataagcattcgggtaagaaccaactcagttttttagttgtttttttttttttttttttcaccccgttgaaagaaaaggataagagataaaggactaaatgattttaatacagatagacaaccattgttgacaggattgcgattgtaagagtagacagtacatcaagcgaaaataaatattgcaggaatggttttgtctgataaggagttgtttgccataaataagaaagccgtcgaacaaggtttcaatgtgaagcctagattgaactataatacggtcagtggtgtgaacggtccattagtcattttggaaaaggtcaagttcccacgttacaacgaaattgttaatttgacattgccagatggaaccgtgagacaaggtcaagttttggaaattagaggagatagagccattgtgcaagtgtttg

SEQ ID NO: 15083 - DNA, 438 bp, Saccharomyces cerevisiae
gtccgcttttggcttcctcacttatttcttctttctctatatatataaagagtgagtgttgtatataagtaaatacatctggtatattattttttttttttcttcattcttaaaaagtattaatatcgatcagcaaaaaaaaattaacaaaaaagttccttattatatctgcgtagaagtacttatttctgctccacctttggagtatttttccaaaattgtgatgccaaatgagtaatgaaatagaatttcttgtgtggatcgtcattatcgatttggtttggacagttaaaggagaattttggaaagaccagaacatcacttagcaattttggttgatttaggttatggaataatttccatgtaaccttctccctgacaccacttctcataaagtcattgaaatacgtgaaaatagtgtcagtccacaacccagaa

SEQ ID NO: 15084 - DNA, 458 bp, Saccharomyces cerevisiae
gtatgtcttggacctgcataatttttatactttttccttttagatatatgtacttttggcttaatttaatataattaactataacttcgattttattctttgaaggtccaaatgcacgtaattcataaacttatgatgcattgttctatttcttgaagtccttgggatgagtgatgagaaaattttcttgaaagttaaataatataataaaattctaaaagttaaattttatagctaaacataaactatttcttaaaattctttggcagtatattttctttgaaaaatgagaagatataatataccaatcaatgaaattgaactgcagagaccgagccctgtaaaacaccatccaattcccattgcgttacagagctgtaaaatgatagcggaactaatggcagcgcccacatttcgaaagaaactactaacagcaacagttccagcagctcttttgg

SEQ ID NO: 15085 - DNA, 435 bp, Saccharomyces cerevisiae
agcttatagactaagacgtattttatatagtttacgctataagttacggcgatattatatatatatgtaagaatatatacatatatattaaaatgattatatgccctcccctacatatcagacctttacagggtaaccttaaaataaactgctaaattatttggtttatgaattaaaagagcaataataacaatggcgggagcactgtttcgatgataggtaagcctaaaagactagtcagacgtatcttacgccatggacaaaatcaatcctgattgggcgaaggatattccgtgcagaaatatcactatttatggctactgcaaaaaggagaaagaaggttgccctttcaaacacagcgataacactaccgctactaccataaatgacgttcctcctccaatagatgtgggtgaggctacaactccgaccatg

SEQ ID NO: 15086 - DNA, 431 bp, Saccharomyces cerevisiae
actgaatagcttttgggcaatatcaaccagaataggaaaaattcaaaaccattttaaataaatatatatttatatagttgtacatttttttctcttacttaatataatatgatttttagataataaaagaaaacgtgcatatatacatacacatgtatctcagatatctcattatatctattagtaaatatggatgcgcttatctagctcgtaaaaacggaaaagaaaagcctggtttgagcgcttactgaaattcagaagctttaccggccatcaataaaccaacaatcaaacctaataaacctaaaatggacccgaaaatttcaatgaccaaaattttaacaaacaatgcggaatcagcagcatcggaaatggcagcagtcgcaccggtgataccgacagcgataccacaaatcaaattggaagcaccg

SEQ ID NO: 15087 - DNA, 459 bp, Saccharomyces cerevisiae
tgatttgttggcatgatctaataatagtctcttatataaaccctataataatttcttatttttgccttatattcaggtaaatcaccatctaactgtattatctctcacgtatcttcacttatatggctcagaaaacaccgtacgaaacgaaggggctgcgaaaatgtttctagaaggtaatggcaataatagggatacagatcgatcagatccgcctatataaaagacaacgcaccgaaggtgaacaagatcgcagataaaggtatttacaagggaaaaaagtcagcaaaaacaagagataagataacaagaagaagatgttaaggagggaaacttcaacaatatacaggacacacaaaaaaagcaacagtagtatactcaggagccagcgggaccagactagagtggattccttggtagaggagtctcccatgggcgatttcgggatcaataaccagc

SEQ ID NO: 15088 - DNA, 429 bp, Saccharomyces cerevisiae
tcaggtatgtaagggagtactcaagtgcatctttggatagctatatatagttgtaaggaagagctatgtaatttttgccattttgtacatattttgcatttgtcctatagtatgtaatacttacatcttactgtcttcaattcctcccgccaacaaaagatttcgatagcgccgcaccatggagtttatattgttatttccgagacgacctatataagggaaaagacgaaaactgggtatttgatacttgtctaaacttcaatggacaaatgatataaaatacaaacaatgaatagtaaccgatgccaaacgaatgaggtgaataaatttattagtagtacagaaaaggggccttttacgggcagggacaatacgctctcttttaacaaaatcgggagcagactgaattcaccaccgattctgaaggat

SEQ ID NO: 15089 - DNA, 466 bp, Saccharomyces cerevisiae
aaagccgatgttcttaccatgaaaatttgaattataataacacaattttacttatcgtccatctgtcgacaaagatgttccacataagtttacgtaaagtttagcagtgaaataaatactgttcataatgaacttcattgtttataaaagttgttgttgcaagtattctcatgtttatttatcgcagacttgaaatctttgaaggaagatctaaggtctacacactatcggttactttgtgaccctttgcttaccatacggatgaaaaaagaaagaggaattacttgagccacaatatccttcactcatatttgaaaatagtacttactaaagaaatatgcaaccatttatacacgtaagaagttcaattatcaaatagaaattaagcaaaatactcaattgaatacagagcaaaaggattagccatacgttctagcacattttatgggcctaagacatcatttcc

SEQ ID NO: 15090 - DNA, 454 bp, Saccharomyces cerevisiae
tactaagtttttggatgtcttcgataaaaaaaatatattattgtgtttagacttaagtatgaaaattttatgtatgagctgtggctatgtatccgctggcaaataggtctgctttttctacactttccaccctcaacctaacagagcccgctggcacaaataatcgatagtaggacaacagagctactccttcttatgccccgcccctttgagcttgttgtattgctcttgatagttgtgtttttcactttcatcagcatcggtagtcttgccgtccttgtcttgactagccattttcttaaaagcgtcactcactacctttgcatcgccctgcaatttttcctttgagctctgaaatatttcgctcactttttgttggtctgtattcattctggatgtcttggttgtagaaatttcttttattggttcattaaagtcaaggtaaatggcgaga

SEQ ID NO: 15091 - DNA, 467 bp, Saccharomyces cerevisiae
aaaggttaagcaattgtgtatctacttataatttctttatagtcttttcaatgtttttttactccatcagtctacagatatgaaacctcagtactactttttacctaaataattaatttttatttctagagggtagcaatgataaacactttaccaatctctggaattaagaacaagcgtactccgctctattcagtattatttgcatgaatacttcaacaattgttttgtttgcctcaggtgcttttccgattgagcacgatcgccataacattaccactgaaaagaaagataagatcaaatgttacgtggtgttgaagaaagaatgccaaaaactaagaactgaacttaaacagtaataattttgagcattgaaaacctaaatataacttcttggtatacaatgcagaaaggaaacataagaattgccatcgataagggtggaactttcactgattgtgtgggga

SEQ ID NO: 15092 - DNA, 437 bp, Saccharomyces cerevisiae
tgggtttaaatatgaaaacgtcagctgatattttgggagaataaaacactttcttctatgcccaagtttttttaaataataaactgatattctatatacatttacagtcttgttcttcttcttccattacttttttcagccataggcggtcatcgtcagtaacctccagaagtctcaaactggaagattcttgtagaattgacactgttaatggtgaaccgacgagttcatcagtagatatgtatgtactgatggacgaagaaaatgtatctttatccgcatgatttactctgatgtaagccagcttatcgtcaacatgcaggaatgaatattctacaccttcaccaaaaataccataactacgtttcaatgcgttatttaaccattgcctccatgtcatttgatcaatagcatgtgcatcgtccacatcttgatcg

SEQ ID NO: 15093 - DNA, 490 bp, Saccharomyces cerevisiae
taatccggtcctgagaaaaaaccatatttacttaggtcatatatattttatattttaaagcaaccacccgtaagcatttaagtctcttaagccaacaaatcgcctcgccatcttaatcatcgtcatcagtatcgaatatagattttggtgggaaagcggttttaacgtggtccgctaattgcatctgtccatttccatcgttcgtgggacatctatcaatggtaattgcgcccacctttgatttcaataacgtgaaagtaccattgttatttttgtctggattattaggcaatagttggctagcttccaaccgctgctgctggtcctgttgtatatgactttgtatatgcctttgtggcgcatcctcacatttgctgaaatcgaattcgggaggtggtgatgctgggggcgatatcaggaacattttttcactctctggtaccttcaagtattgtttagttaaattcctttgtccgtcttgcaaggagta

SEQ ID NO: 15094 - DNA, 421 bp, Saccharomyces cerevisiae
atatcaatatataaagaggggtttgcttttgttaagaacaaggcctgcacctcactaagatctgttgatttggcactatgctttttaaaattttgtttatactcaatttcgtcaagattttttttactagtacaatccatacagttaacaaaatactgggcaataaggcgtgcatactacgaaatttttagttttgttataataaacgacttttagctagtgttttaagataaagtgacgaaagttagggtgagaatagtcgaatgtatttactaattattgaattcgtggtaattagtacttatgatgatggggtttaaagggctaaatttagacaatagaaacagtaataatgatgttttctatttttctgctgtacgttgctttttattttatatttcttcggaaaaaggttcagtga

SEQ ID NO: 15095 - DNA, 488 bp, Saccharomyces cerevisiae
tttgtgcgttagaacagtgaacttttgtatcgaactttatataataattctacggatgtatccatcttatttcttttcaaaagaatggaagaatagaaatgtaaataatgagttaaaaggggcagttgcttgatattttgacacgaatttagttacaacattttgcatatagcttcaagtgatatttatttatttttaatatagtaccgtggactcacagtttgggctctcgctgttcttcaaattctaaatcttgcttgaaaaagccgtcattaaaacgattctgagaggtcttcttaacaaaagcttgagagctttcaagttttgaagctttcacatggggatcaccatttttgagcgaattctgagaatcatttgaggatacagaaaactttctattttctttgttcgcaaacatctttgaagcattcatatttgaagccgacggtggaactggaaaattctcagtgtctttttccttcctgcct

SEQ ID NO: 15096 - DNA, 460 bp, Saccharomyces cerevisiae
aaacatgaaaatttatatacgaaaatattctgcttcttctcacatcaatctaaaaatttttttttgaaatttcttttatttttaatatatagttctgaaagtctatttttaaagaattagttcttctctgtttaattgccacattgtaatttttttttggtatgttgaagtttaacctgtacatttcttttcttttaaattgaatcaaagaccaataaacgggatccgatcacaatatgatcgtccaataacgctccctcttgcacttcacttactactttataaacctaatttttattttttactagattccttttttcttcctgctggcgcttttttttttttgcccgtccaaaagttttcaatgaaaagtaatcctcttgaaaagagatacttctttcgattacaataatgttcttattcatatacaaatagaatatcagaagatcggaaacgagtt

SEQ ID NO: 15097 - DNA, 427 bp, Saccharomyces cerevisiae
tgagaatgaatattttcgcgtatatattttaattaagggtttatatacataaaagatatatctaatgatctgatctgagtcccgactttttatatgtgctctatgcttgtattatgctcatttatctttacttggtttctcattttttagaggtggcaaaattggaaaatcccatcatttgactgacttttgattcactctcaatagaaggcttagtagccactttctttgctttctccacatctgtgtccaaaagccttttcctcttggactgagtctccatagaacgcacctctacaaaatcctttatcaagttatgatagcacaactcaaactcctcttgcggtacgtcatcattatctcttatatctataattaacggttcatcaaacaaattttcaaattttattgcatggaccttgtggtt

SEQ ID NO: 15098 - DNA, 478 bp, Saccharomyces cerevisiae
agacgtttaatagaaagaagaacaatgttaagtagttctataaggaatattaaatgaatattgtcttttttgatgatttaaaaacatataatgtaacaatagtgttctttttaatttaccggtggtaatagcgaatagaatcttataaaacttacatagaaaaaaaatatatactatacttacaacttttcatttttttcgtaaaaactaccccacaatgaaataagataccataccttatcgagttattatgtatgtgtcgaagctttttaaaccaaagcaaaaccgacaccagcggcaatggataaggaaatgatggaggtaaagaccacttgtgctaagttagctttaacgttggtggcagcattcttcttgctagaagatgaagatgaagctgaagaagaagaagaagaactggaagaaccagaagagccggagttagacttggaagaagaccccgaagcgttagaagaggcag

SEQ ID NO: 15099 - DNA, 482 bp, Saccharomyces cerevisiae
aaactgtgattaacttttgaaaatcataaccactgattacggagattttatatctagtccggaaaaagaaggaaagaataaaattttatattgctttgtatatacgaaaagtcgcccatacatgtttatcttagtatccgttgtaaatatatgtacatatatacatctacatatgttcccattaattagtacatttacctcaatagggttgggcgtcctcatgaaagataaagggaaggaaggaaaaacgataaaagcacaaaatgtgacatatcaaacatttgagaaatacgttgagtcttcttcattctttttcctcgtccacaattttctcaattcatcaacgatgaaaacgctactgctgatgagcaataacaatagtatatcagagataccaagtttctcagttttaaagatactttggaaaaatggtatatatatagcgcacatttgacctaacagagacagtccaacggcgtagt

SEQ ID NO: 15100 - DNA, 455 bp, Saccharomyces cerevisiae
tataatataattgtgtattttccgaagtataatgaaaaccaatagaaaacttattataagtccaatgaggtactttaaaaatgtgatatttataagaacattcctgaatgcagatatatgatatatattgtaaatatatatagatgtgtatatgtatttccattttgtgtgaggttttcttcttttatctcctatataatttgtaaccttaattaacccatgacataaccaatattagcctttgcaaattttgtaacttcttgacgttgttctaacgacaaatcttcatgcttcgattttatatgccttgttaaagcatccagtctcgaaaacgtcttctgatagccctcagatccaagaatttttatacactccgagcaacggaagacaatcttccttttagcgtgaatggtattttggtgtctcgttaaatcataggaccttgaaaattgggc

SEQ ID NO: 15101 - DNA, 462 bp, Saccharomyces cerevisiae
acgctctgaatgcaaagattcaatgagattctctaagaattctattgataagatttaaaggtatttgacaagtagagatctttattttttcttgcattttgtctagagaaatctcaactgacatactcgacatgaaatttttggtattgtgtcttttattctattgctttaagaaaactgtgacatatagggaagacatgcttaacaagaagatataattatataatatatatattattaataataacatccttactgcagtcctgttgtgggagaaaatggagagagactatgtttcgtatcaattcctaaaatcaaaaaaaaaaaaaaaaaaaagttaaacaagcactcgctgttcatttgttttacaagtattcatactctaataggtcattgagcttcttttcttgaggagagatccaatttgaagtcggaataagatttgctttcattagcgtaggc

SEQ ID NO: 15102 - DNA, 456 bp, Saccharomyces cerevisiae
gatgagtaaaaacttttatgatattttgcaatattttttttaagcagtggtagtaattacataaaaaatataaaatagtaggagtattattaacttctataacttattatattatttgtttagtctctctttttgggttctattcttttgtgtgtgcgtccgtgtcttattatattacataatggtacagctggatccactgtcacttttcacttcggttgctactgggcccgcggttaaagcaactcttgcggcttctgtgaaagcttcgttgacacctttattcagcttagcgctacattccaaataacgtagcgcaccgatctttttagccatagctagaccttcttcataacttatcaggtttttgccgtttgaggtgctatttatgttatttccgttgtcgttagaaacgctgttatcctgttggatattgttcggtgtgattgcgttaga

SEQ ID NO: 15103 - DNA, 433 bp, Saccharomyces cerevisiae
ttgctcatctcttatactgtctataatatttaaaggtatagtgtttcaaataaactaggatataaaaaaaacaagattgactaacataaagaaggccggttggtgtcgcttagtcaagtcatcgccaagctattgaggaccattcaacctttttgctttgttcattttaactttataataaggaagatatatcaatccttgaagttaggcatccttctaccaaaaatagcggaaagaggagtgataatcgggaaaaaaattttcatattaatacacatttttatacatttacttgtcattatccttttgggtgaaaggatgtattatgtattgtttctcagaagggcttctaaattagtccaaataatgctgttatggcacctaacaaactcattagagtattagtgttcgcataggaaatagccgcagcatt

SEQ ID NO: 15104 - DNA, 490 bp, Saccharomyces cerevisiae
gtaactcttttgcttttcctacgatttttcatatctcatttgtagccatctgatatacgtttatctatatgcaacgtaattttttatttatcgtcactttgtagttttccggaaaaggccattgaaaatttttcaaattcctatggcgatgagctgaaaaaattcattaagtgtgcattcaataacatcttgttatatactaataaaagaggcttcaagacaaaataagctaacttaaatatggcaaaaaagaaatctaagagcagatccaagagttctagaagagttttggatgctttgcaacttgctgagagagaaattaatggtgaattcgataactccagcgacaatgacaaaagacatgatgctcgtcgtaatggtacagttgtcaacttgttaaaaaggtcaaaaggtgacactaacagtgatgaagatgatatcgattctgagtcgtttgaagatgaggagttgaactctgatgaagcgttgg

SEQ ID NO: 15105 - DNA, 487 bp, Saccharomyces cerevisiae
tgaagacttagtattttatgtagttgtggagcttatataaagaaatggacaatattcgcaatcgcttctcaaaagggaaatattttcccttttcgggcggtggtcgtgttgacaaatttcctagttaagaactaagatttggagatggacagattcattaataaatttcaaaataagcacagaaagcatcgaatttttagctcaaaacaatctacttttcaatcatcaaaacagactattgaataaagatgggcaatgtgtctgtggcagtgggaacggcagttgggattccaattgctgtgggcgtaataatagccctgatattttggtgtaaattacaacgacgttacaaaaaagaagagattagagatgctgatttggagaagatggtaatggaagaagtggcagtgtcggtatatgatggttttaaagccgaaattaacagctcaagtgaagcttccacgataaacgaaaaggaagcaaacca

SEQ ID NO: 15106 - DNA, 451 bp, Saccharomyces cerevisiae
tgaatggttttaacaaaagttcataacataaaacctttttctccttgaccaatgcacgtataacatcattatatagcagatttaataacaacatacttaaaagtatatatgcgtcattcttatccagttgtgtagaagctagtacttgtgatcaaccattggcagccatctcaaagaatcgtcgtgcacggagcgtaaatcgcgttacttttttttttgttttttttcccgcctcgaggttggttcaacagcagatcatggtgactggcgataggttattcactagaaaatgaagatactctttcttgggaggtaactctgtaaaatttctaatttgtattttatagtgtgtagaatccgaaatatatccgatctacctcgctctttttattgttatttttattcgaggaatttaagtgttttgcagacctatcccttcgaacacgtaacg

SEQ ID NO: 15107 - DNA, 440 bp, Saccharomyces cerevisiae
agatatacaaaacaaaaaatgcttaagtatttattattactgatactgtaagtaaataaatagactgactgaataaatatatgggggttatttgctcttgttttataaacagaatatatatgtaagtttttagaagatcaaaagatcgatgtaatgtagaggcatggaaacaatattaaacattaactctttccagctcttctctaccagctttgctgtacagaaattcattatactcgttaccgttcttccaccagtaccaataaattcccgcaggtattaatacatatagaaattgagacttaaatcttctaaaactattgaatacagcgttatggaaaataccttgtaatggcttttgagcatatggagacacagcatatgaggttatacctttttgctttggaccacccatgtgaccccaccatcccatgtaagtt

SEQ ID NO: 15108 - DNA, 428 bp, Saccharomyces cerevisiae
gttaatttatttttttgtgtagttaaaatcatcttcttttatctaaatatataaatataaatttacttttaatcaattaaattaaccttttagaatcggaaaggatacgctaaggaggcgatgttgaagtaggtcggcaggttcattatatatttaaataatgaattttccaatgatgtttaaaaggagaggaacattcttgacattgttaatcttatgatcaaaggcacaatccgtaggagaggaggttttgtcatttgaattgtatcgtacagtaagtttctctagtattcttagtaatgaccataaaagtgcagatatagtcctcgaccctgtagccacagttagctgctgtggtgttaaacaaaggcatttcatccgagcgtaacctctttgtaggagttaaatggagtatcgtgatagagccc

SEQ ID NO: 15109 - DNA, 476 bp, Saccharomyces cerevisiae
aagccataataagaagaatatataggtacatatatatatatatatatatatatgaaatgaaaagtacgagggtaatcactttttcctctgaagagctagttttattaagtcgaagcagttcttcatgtacggtaaattcttgttgcaagcggtcacacccatatgtccaatacggatatacttgggtccgatgtccttgtgaatacctccggcaatgactacaccgtgtgactttaaaaaagcaatgacatcaggaggatctgctacgtatacggctgtcaacccgtgcgcagacatgttagaaggatacctactgacggatgtcaattgcaagccattaaccaaactgtctttaaaccaatcactcatttcacggtgcaaatcccatctcttatgcaacccctcttcgagaatttctttcaaggctacatcaaggctattaattagttgtacgggtggggttgcaaaataagctc

SEQ ID NO: 15110 - DNA, 452 bp, Saccharomyces cerevisiae
gctctctgtgtatgtatgggttcctctttgtcattgtgacattgttttgtttttagtttttctatagttttctgataaaatagtctaaccattaccgatgttgctacttgcatcattctcaacgtctaatcaacttgcgtttgcgtctcaaattgagtttgtaggttacgtgtcgccttaatagtcagcaaatgccgacgtttgtgagacggataacgactgcgatgattcccattccgcatgaatgatgcaattcacaattcaaacacgatatcaaacgactaagccgtgaattaacggctagaatgcaaaagaaaatgggtaagaattgatttatgtagatacggcaagacgatactttccttaaacagccgagaaacgaaaaggtttaaagagatgtactgtgacgtagaagagaaaggattacgcagcaatggcttgtccaaatttcg

SEQ ID NO: 15111 - DNA, 472 bp, Saccharomyces cerevisiae
ttgtagtacgaatttttaagttgataactaaattactcttcaacaaataaataaatgcaaatgaagtccattatgtacgatttttaaagtgcaagttactttcaaattactttacatctattctatcaaaaacgaccaataatccgccaacaagatgtaatgaaccagttacaaatatatcagcaggttcatcgtatagcgtttcaatcaattcatttgcttcctctatactagccgttacatgcgttttagcacgattatcgtctattttgttccaattcttgactaatgactcctggactttcaatttttctacatcttcttgagaagtgttcatggaaacgaggtcagcgctgtatgagcctgatttccaagtgacattagtagtaaatatcacatcatcgaacgttatttctggcgaaacagatgagtacaggttattcacaagagcgttggcatctctgctttgttg

SEQ ID NO: 15112 - DNA, 491 bp, Saccharomyces cerevisiae
tatgtcacattttgtgcttttatcgtttttccttccttccctttatctttcatgaggacgcccaaccctattgaggtaaatgtactaattaatgggaacatatgtagatgtatatatgtacatatatttacaacggatactaagataaacatgtatgggcgacttttcgtatatacaaagcaatataaaattttattctttccttctttttccggactagatataaaatctccgtaatcagtggttatgattttcaaaagttaatcacagttttatttaaaactgtatacaattatttgcagccgcctttcgcaatctgttcataacagctaatccttctccttcctcatttataccttcgacaaatattaggtctactttatcattttcatccacttttcttaaagctgcaaacaagttagtctgtatttcttcaccagattggccaagtctttcgatgatgaaagttttcgaagaaaaatcgggttcat

SEQ ID NO: 15113 - DNA, 468 bp, Saccharomyces cerevisiae
atcagtatagtaatgtccttcggatggtatattaggatatatgacgaaaataagtaaatttaaacaacaatatatatttatattgatctatttttctatcacgtaagttgacatttgtattatacattacatcacaattagtaatggaaagtgtttggaaaaaaaagaagattattttgcctttcttttgaaaaagctttccaatgttccttgcttttttaaccttttattcgatgacggcgtttcttgcttttttgaagacgacaatgccctttttaccacgggtgatggcttgcgtggtggtgttgaagttgcgggtctctttgtcacaatatatccatcctcatcaataaaagaggagggctcttcttcagatttaggttcctttgaatgttctgtttcagaaggctttgtttgctgtattttaggtacatccataagtgaatcttctgctgtcgtttccaacaa

SEQ ID NO: 15114 - DNA, 482 bp, Saccharomyces cerevisiae
tttggaaaataattcaatacatactcaatataaagaaatcataactctactttagcatataggaaatagactctttcgaaaaaacctctttctgtagtgttagaaagcaaccggctattatttttgtgtgtcttcgaaaaatcggaacccaaacagatcttagcggattcatggtaaaaatagccttgaagaatttaggaaaataaatagatactcaaaaaggaatagaggatcttaacaaatcattacattacttaactcacattaaaagcaaacacctttcttaagctgttggtgcaaaaaaggattacatctattgcccttatgaatttgttttggccatcggaaaccaaaaagcaaaatgaaatacctggtggcgattatacacctgggaactcaccttcagtacaaaagggttatcaattcctcaatcgagacatatttaaaagttgtccacgaattatggaaaggcagtttggtga

SEQ ID NO: 15115 - DNA, 458 bp, Saccharomyces cerevisiae
gagacgggatttagttttactgcgcatcattttcacgtcatactctttgtctctctgttctatctcttcgtataaatatttcaataactccatttgtctattctatctacccgttctatccttactactagatatcttaaagaaataataaaataagtaaatacaaaaaaaactcgctattaataatttatctccgaaagccctagggtgtgcttttcttccgtgccctagtctattattttgaaccctagttggcgaaatttttttctaatattcagaaaaaagaaacgtagagcttatatggtgaaggagtacaatgatactaatagtctgtagacggcaaaaggcattctttttgactagcacaacgacagtttgagattctgttgaaataatcatttatgtctctttcggtcgccgaaaagtcgtacctatacgattcactagcaagcacgcct

SEQ ID NO: 15116 - DNA, 494 bp, Saccharomyces cerevisiae
aaagaatgcgagagaaaccctattaaactattttttgtctaggataataatattagcgctaatctaaaaatcgatgaactaaagaaagaatatacgtacgttttatacacaataaatggatttcataagaagtccttaatatcctcatgcttgtggatactggaaattagtaaagtaattaacttccttttagcattattcttatttggcttaaaaaggtcacgtgaagctctatttttttcgtttttttttttcactgatggaagagaaaaacctctacataataaggtaactttacatattgattgccaatgagatgttaaaaaatggacggttcagacagtaaaatacatttagaaaaaaagagaaggtcttatcagtgtatttattcactgtgcatattagctttttttggactttttttgttccattagtacttttaaaaaacctatttgtaaataaaactaattctagcactattctttgcactagaa

SEQ ID NO: 15117 - DNA, 444 bp, Saccharomyces cerevisiae
tacgagcgcaatcgtattcttataattgacgagtgaaccaagaaatgcggtgatacaaacggatattaatctatatagatatatgtatataataaaagttttcaatctgctgaccccttaggttacttatctataggattcgaattacgatatgaaaccctttcggtagatatcacatggaatactgcagccgattgattagttaatttcttatctcgctttttttctctttatctatctatctatctatttatctatctatccttatgctgcaaaatgaaaaattccctaggaagttcgcgctatcaaggttctttttcccacgtatcggtccctgagtggatcccaaaaaatgtgtgggactatgactatatatataacagtcacagttgaatcatattaatgttctatttcttgaggtgatttcaaattgtggctccaaca

SEQ ID NO: 15118 - DNA, 444 bp, Saccharomyces cerevisiae
agctgatagaattgtacttctcgctatataattttaaaacctagctgttattttctaagtaagtaggctcttccagcattctgcttcttcgccctgaataaaaaaaagatgatcagcgaaaaaactcaaaatgaaaataagagatggattcttcaaagttataattcatatgcagaataaagattctaaagaaaatgcacacaatgcatattccatccggtgatgttctgataccgaagccgaagcttattactgaagaaacagatccactgcatataataaagacgaggcaaaagacacatggtcggcccgtgaccattgcaggcccaatggttcggtattccaagttaccattccgtcagttgtgccgagaatataacgttgatatagtttactcccccatgattttggcaagagaatatgtccgtaatgagcatgcaagaa

SEQ ID NO: 15119 - DNA, 428 bp, Saccharomyces cerevisiae
gcgaacgatctttcccaaaacaaacacaattactggtagattactagtagcaggcggaggtggagggcgggagccactgttattgcgtttgtataatatatacactcataaatgatatatttaaggttcagataaaaacaacttttttttttttagcacgtctttactgcagtcaccaaacccattttttttttcctattgtgaatacccgcccatatttttcacacacaactgatgagtaatataaaacttttctttaaaattataacaagatacacatatataaagaccaaaaaagggaacgtgacacggcctcgctaatatacaatcataattcattaactgatttggctaatgcttcaataaagatatcagcatgcttctcctcgaatgttaatgaaggtcttaatctcactgcatggactgca

SEQ ID NO: 15120 - DNA, 468 bp, Saccharomyces cerevisiae
aatcgtgcttatcaattttatgtcaccctaaaacatctgtacgtgtttatatagatatttaaagcaatatttgccaggatttggtgaagatccctcatataactctcataaatgcggattttcggagcgaaaaaagcctaaattcttgtctggaagtataattggcggtgaaatagaaaaggtggcaatcacgactgaaaagggtacagctttcgcaactgacatatacagacagtgaaaagtaataaattgcccaagtgtgaacatgtcaggtgtaagctctgttatgctcggtcttcgacctgctacaagaatttttttccgcagtaatatttcggtttcaccttcgaggacttttgtatcatatattggaagatcccagagcacgtcgatactcaaaaatgctcccaacttagaggacaatgtcacaaatcttcagaaaattataccgaaacggttcttttctca

SEQ ID NO: 15121 - DNA, 448 bp, Saccharomyces cerevisiae
aagggtgaaaatagatgataagaattttatacgcttctgtatgtaattttttcaatttctacacattaatagcgatccttttttaatatttgaatttagtgtaacgcgaaaataaaaatatgaaagtacttacaaaaggttagagggcgacaatacaaaagaatacctgcctctgaatatatctaaaaaactattgaataggtttgaaaaactcataattcagacagttattatggattcaatagatgaacaaattgctataaagcgaaaagaacttcagtcattacaaaagataaccagtttaacggatggcttaaaaattcagctaacagagttgaatgagcagatcaaagaaatgggaatgaatgcggattcagtggcccaattgatgaacaattgggattctataataaacaatatatcgcaagcaagtttgggattattgcaa

SEQ ID NO: 15122 - DNA, 461 bp, Saccharomyces cerevisiae
atttcccagtactctccacatttttatgtaaagtcttctataagctctcgagcgtataattaaaaacgaaaatagacaaaaaaaacatcatgaataaaaaaaatgtcttgaagctgactatattgtccatctgcgtttagagacacgtattctatttcgctcaaataagtatgatctgcaagtagtttcagtggtattatcatttcgcaccgttttttttccaagaactcgtttacgtgccgcgaaaagtctatcgaataggcattcgagaacaatagaaaaggaacagaagcgtagtacatattatgcatagacccgtttcttttcttctttttcgaaaatattcttattgatttaacaattaagcaggtgtgtaagatcataactgctttaaagatgaataaagagcatttgctgaaggtggatcccatccccgatgtgactattaaacgcggcccttt

SEQ ID NO: 15123 - DNA, 411 bp, Saccharomyces cerevisiae
tgaaaataattctgtttttttttttttgcgattgcattttcaactctaaatattactctaacagtatttcctaattatttcataggtaacattgtatgacattttaattttattgtccttattattttacttacttagctgacttttttgaacattatcagatgggtatatagatatttacaagctcgcgttataggtggagacatgtgtccttatataaatcgcaaaaagaatcgatcagacatttaaagccgtgctttgtccagcaactttatggaatcttttctactttcaagaaagacatttatcattgttttcttgtctttatcattccctagcttttttacgctttctaggcaatctcgtgcacctttaaaattctcttctttcacacagcaatcgaaaaatcca

SEQ ID NO: 15124 - DNA, 401 bp, Saccharomyces cerevisiae
actgcaattgttagatgattcataatccggtatatttattgccctcttttgtattttacaaatagtaaatatatataatatcttgtgatctacataagctttcgcggggtcttcagaaaaataaaaagtttttaaaagaatatacgcttagcaaaggaatagacagatttagtttgtacgcaaatagtttttgaagaaggtagcagattgatcaattttgtatgagcggaaatctatccttaaacgccaactactacattacttgcaataaaaatgagtgcagatttatcgattggtaatgaaattaaagattcatttaaggaaacccataaatgggtccaaaataacttaaaatggttgaaggacattgagcaattttatcgggaaagggctaagttaga

SEQ ID NO: 15125 - DNA, 499 bp, Saccharomyces cerevisiae
acgcgttaattccaactattttctatatttctattctatccgaactccccttttgtatatcaatatatcttaatactttcgcctattctttactatatttcctaaattttctctggtctgcaggccaaaaacaacaacttactactgaatcatggacgtgtatttagtttagccaagcaatatttaaatatcactcttcctaaaaatacattgggcattacccgcaaactaacccatcgcttagcaaaatccaaccattttttttttatctcccgcgttttcacatgctacctcattcgcctcgtaacgttacgaccgaaatctcactaaggcacggtttgttgggcagtttacagatgttggataaccagttgtttctaaacggttatgcctcatatataacttgttaactgaaggttacacaagaccacatcaccactgtcgtgcttttctaataaccgctatattagacgtttaaagggctacagcaacaccaatt

SEQ ID NO: 15126 - DNA, 408 bp, Saccharomyces cerevisiae
cttgtccaatagtacgttacattcacatataaaatacttaagttatatacacaaactaaataaataaaaatcgaggtatcttttctttcgtccttctatatatatagtttaacttactcttattctttattatttttccttttagggttacccgtcaatcctttttattaaagatgttccagcttcttggtttagaatttgccaccttaaatacgtacccacatagtaaagtacagctaagttaagaaaggggataagcagcaggaatccttcatcttccgccgaaaacaacataaaaacccacacgaatgaatcacgatcctttcagttggggcaggcccgcagactctacttatggtgcttacaatacacaaattgcgaacgcaggcgcctctcccatggttaata

SEQ ID NO: 15127 - DNA, 404 bp, Saccharomyces cerevisiae
gtaactaattaaccaaaataaaaaaataaattaaatatatacattaaatatgtatatatatatgtatgacttttgacaactttttctttggtaaaaacttattattattattattattattattattaatgtagtctcgaatatttgagtatgttttagttttttgttttatattttctttgggtttaactgctttggttggaaacaatttggaataattccccgcgattattatataaagtgtcgaagttacctcgctcaaccactttaccatctttaagaactgcaatcgagttacaagacctcatcatttgttcactatgcgttataaccattgttagtagagcaggtggaccttttttgacgatctcattgatgatagaggagctgacagaatccaaggc

SEQ ID NO: 15128 - DNA, 448 bp, Saccharomyces cerevisiae
tgtgatagttatcattatgtaagtgcgtaagtacctaaatagcttagcctgacgacggatgaatatgttgacagtctagcaaacagtagtagtccactactcgatataaaactgtaagcaccattatttcagcatgcggaacaattgttgttactaggtcctagaaatcccttaagatggtaaaaaaatagagctataaactcagtgagatttatttttgtgtcaagaaattatacttgcgtgttagttttctctattcccaccattacgtagatcttccgtcttttttttttctttttctgcatatgacgtctgttcttccttccccccctggagtacaaggaaagtatcactattagaactctacagtacctttcttccacgccctttagtgcatttagggattttcattactgctaatccaagacttgaaccggattgttgatca

SEQ ID NO: 15129 - DNA, 462 bp, Saccharomyces cerevisiae
tttacgtaatatctcacattaaacatgtaggttttttagaaaaagaaaaaaatatttcatgtatatgcctatatactattttgataaagccgaataagatggtaccataaatgaggttgacatggcttgaacaaaatcatataaagtataattaacaaagcggaaacaacatttgtcacgttagaattatgcgtaaagtagctaatcctggcagaataattcaatgatttttttttaaaagtatgtacactattatttattttctggcattttgaactaattcttcattttctgtacgaccatgcacccttgatctaagcactagggaagtcgacattatcatcgaccttaaatggggttggaagtggagcgttaacatctttcatttgcctaacagtttcaattagtgctacaggttccttgggttccctatctcttaaaaccaccacaccgttatttcct

SEQ ID NO: 15130 - DNA, 424 bp, Saccharomyces cerevisiae
gcccaacaataaataagaatatatgtatacataacattatatattggtactttatacgtgtgcattattctgtataatacgaggcaacagatgaatcaagaaagatgatgcttttaaaaagctcttacaaatataatgatattacatcaaatgatattattattcttgatattgggtattctttcgaattatatcaagcttcccttccctcgccttttcgcctggaaatttttcaatgccgagattaaaaaatttgtcaatgaaaatgcattctactacttaataaagaggtgatgagcttataagccaacttcttttaaacacaaaactaaatctgatattgaggacccccaccaactatgccaccaaaagaagctcccaagaaatggaaggcgccaaaagggccaaaacctacccaccgtaa

SEQ ID NO: 15131 - DNA, 447 bp, Saccharomyces cerevisiae
ctagataatgtttgttcttgatggcaagaaatacacaatgtcaacacccgcgctttctcttcgattcattagttgatatcattaacattatattatacatactttatttctcttggaaattaaatatttgatgatggtttatctaaatattgtctcactcattttcccttttttttaagatagaatatcagtttgaggcaacaaatgataaattatgattatgtatataaaacaattttaattttattagcataaaaaagggacaaggcctctgctaaaatatcgataaaaaaagaaataatatgaaagacaaaacaaactaactggaaaaaataaaataaaaaacaaaactgatcatcatttaaaaatgttattctcttgtatctatttctactagatagatgaatctctacccaagaaataaactttagcccaatccatagcgac

SEQ ID NO: 15132 - DNA, 412 bp, Saccharomyces cerevisiae
cttctacgcagatataataaggaacttttttgttaatttttttttgctgatcgatattaatactttttaagaatgaagaaaaaaaaaaaataatataccagatgtatttacttatatacaacactcactctttatatatatagagaaagaagaaataagtgaggaagccaaaagcggactcattcttcctgtttgattttcgcctctttttccaacctggcttcaatttctcttaattccttttctctttgcaacagttcttgtcttttcaacagcagttcttgctgaactctctcctcaaatgcctttagtcgctcttcttctaaccgtatttgctcctcacgtgtcatgtaggtttcgttattttcgccagtgctttgcccgtgcatatcggatgctgggttgagaacat

SEQ ID NO: 15133 - DNA, 408 bp, Saccharomyces cerevisiae
atttcatgaacttacgggcttgtatgtaaactaacaacaatatctagtataagtatgagaattagtctaatattcataaatactacaataggctctattatctttgtaatctgcaggggtcgctctcctcgtacaaaattataaaagggtcctgcgtccttttctagttgcacttttctttttttgttctccgagaatttctttttactgggcacaatttttcctcttttctttttgttttaggcattataaagaagaaaaattggcttagagagaatatacttgcaaattgaaaactatagtcactgtgagagattggactaaaaagcgcaaatttgagataaagtgggatcttcctgatattagctgtcgttactggttttagcacgagttaccgactattttgcg

SEQ ID NO: 15134 - DNA, 500 bp, Saccharomyces cerevisiae
gcgagttgttaaaaataaaaagctaagatttttattaatattatcattatactatagtattatcgtttaactcaaacaaaattgattttaaataatttatttatttaaattttgccattttatatgtacattcatcatcatcaatatagccgaaaccaaaataaatagattttgtttttttaagatagaatgtgtcaaaccatggattgcgatctgaataaaaatgacaacttttaagttttcctctacaaaacattaaaaacaccattgaagaataagtggtagtaaataattttacaatgatataaattgtaggattgtataatgcgtctatattggtacatataatgacattggcgtattggacaatggctgcctgcgaatcttgttgtataatttgtcgaagactaaacgcaacaaattgattgattatttgcaatgtcgtcattaggttttgtaatatccactgtgttatttttttcaagttggtgttgacgttg

SEQ ID NO: 15135 - DNA, 425 bp, Saccharomyces cerevisiae
gcctttaaagatctgtgcggcgctataacgcatcagttaaaggtaaagtatatacaatgtcttagatactatatttaggctagctgattcatctaattcaccgttgtaaagggggtaggtcacctttcttatacatattcctgatactaaagacaaatgtaggtttaatgagatggtctacttcttctctcctttctctactttccattttgtatttaatttttcggtgaatataaatgtgtgcgtatgttgtgtgaggctcctctagctcctacgggagacatttaataaatgatcataatatggcgtgaagaatgctttcattcagaagtttgactagcacattcggtttcgtatcacgattccaaattagacggttaggaactagtttatcaatacagaatttagaagtgcaagatggccgt

SEQ ID NO: 15136 - DNA, 450 bp, Saccharomyces cerevisiae
ttaggttaagtcgtcaaaccaattttgactttttttttcctacatttttaatattttgtttctcgttttgccttatttaattttgtgacatgtaaaaattacgaagcctattgggggccaattgaagtaaactaaatataacaatagtcctttgtagttcaggaatgttcaccaactattcaccaaaaattattgtctagcttactttcaataacttatagctatctatacaaaaataatcatataactaaagtcaggcccaaaccaggcaaaacaaaaccataataatgggaattattacactatccggcaatgttctacatttattgaaagcctacccaaaaaagggccttgaagaggtttctcaaccagagcctaatacagcaaatgattcctcgactgaatataaaggaaaaagcaaggatgattttcaaatggtcgaaaaatcca

SEQ ID NO: 15137 - DNA, 493 bp, Saccharomyces cerevisiae
atgtaaggtgcagcaaccggctcgtatagatacggataagatagagtatattgtgcaaacgcgtatatgaaatagtgaatatatacatgccgaacggttccgttttttttttttttggctcgttgatttttcctatccctttgaacttttctatcttttaagggatagaggggctgttcagggaaggaaagatctcaattggtatataaaaagggggcagcaagaaacgaattgcagtgctccttttccctaccagtgcatcaatacaagaacaagagaacaagcaaaaaacatgaaccaagcaatagacttcgcacaagcaagcattgactcctacaagaagcacggcattctggaggatgtaattcatgacacaagctttcaaccctccgggatacttgccgtagagtactcatcaagtgcacctgttgccatgggtaacacgctgcccactgagaaggcacgttccaagccccaattccagttcacgttc

SEQ ID NO: 15138 - DNA, 451 bp, Saccharomyces cerevisiae
gaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctttataatttgtcaccgtggtggaagttttcaccagcgaaaacagcgttgtcacctaattcttcttcgattctcaacaattggttcaatttagccaatctttcggatctagctggagcaccagtcttgatttgaccagttctcaaaccgacgaccaagtcagcaatgaaa

SEQ ID NO: 15139 - DNA, 462 bp, Saccharomyces cerevisiae
tttgtctgtttacgtaataattttgcctgtagattgatataaaattgtgtacggataattgcactggcacgtcaaaagtccgagaactatttttctcgagaatgccgcgcaaagcaggcaccgtgcctttatctttcttttttttcctccagcactaaaccttccataacaatactattagaaaggttgttatcaaatattaaaataactattaaagtgatacaaatatatatatagatgacgatgggcataaaaaagctcgtttctaatcatcaactatacgtttcttgatcaaaatgcactgagcaaaatattgttatgaaaacatacttgcttgacgaaatggattaaatggatccattaaattaaaaaatgagtctagaattgcactttatgatagaaaataaaaattcgacaagaaatggtgataatttaacgaacgaaaatattgaaacgtcagga

SEQ ID NO: 15140 - DNA, 415 bp, Saccharomyces cerevisiae
aattaatgacggaaacgataatatacgttatatattttatccgtacttctataatgtcaactattgtttataaagagatccatttgagtctacagatttttctatttatcaaactataatattccaccactctcttctcagtcgcaatgcttgggtgtacggtgtttgaataattgaattagatttaaatgcgaataagtgatgactaacaagcaaaaaaatcgagtatttcaagatccagtcgaatataaaatcttgctactgcattattctacgatttcctgttatcacttatagtacacatgtctgagtttttgaatgaaaatcccgacattttagaggagaaccaacttcccactagaaaagaagatagtaccaaggaccttttgttaggcgggttcagcaacgaagctac

SEQ ID NO: 15141 - DNA, 407 bp, Saccharomyces cerevisiae
tgataatttgacattcataatattggtaaaaagtaccctacatactacatatttctagaatatccacaaagaatgtgtcgttctttttctgcggttctttgttagctttccttcacttcctttatgtcctctttcatgaaagtgaaaaatgtgaagtgcatgcgatttttgcgttagcaatttgattgccgaaagaggcaaaacgtaaataggttgtttcaaataattagaaggagcatcggaaaaatgcaacgacaaaacctctagcaggcaaagaatttatcacctttaaaatagactggaatttgtcatattagttcctaattcagccaattaatagtttaaatcagactaaaccagagatcagtcatcaagcttaggactaatctgctttgcgactttgattt

SEQ ID NO: 15142 - DNA, 431 bp, Saccharomyces cerevisiae
atagtatacatatacgcaattctttttagatttaagatggctaataaaagtaatataggcaagcttattcatgttcgaatcttttttttctcgcagagctagtactctggcaatcgacacttatttcgtacaaaatgatcacgcaacttttgacaattttttttttttcatctgttttccaggaaacttggatcttttttgctccatagcacttttggtcttcctcaattaaatatttctagatcccggtagttcttcttctttgatcattaataaaaaataagcaaagcataaaagagcagcaaaaatggattctaagaccccagtcaccttagctaaagtcatcaaagttttaggccgtaccggttctcgtggtggtgttacccaagttcgtgttgagttcttggaagacacttcccgtaccattgtca

SEQ ID NO: 15143 - DNA, 424 bp, Saccharomyces cerevisiae
ttggttgataattggtgcttcaaaatttaaatttcgtcactctaattatacttaacatataaatggtaccttcaatatatcttcttagtaaaaagtagcatgattttgtgttaatttgcactttttttatttaaaaataaaaatcacagttaatttttcatgatcttgcaaagacacgcctccccctaatgtggcatatataacaattgtgaatcagaaaaactcaacactttaacataatggcgggcacgaaggctaaacaaacaagattagcattgaatgccttttttgggtacaatagaacagtactgaatgacatcatatatcgaaaggctcaagtcggcagcatcgtatcttgatacagttccagatgagcatcatgatttcagaaaacccaccgccaaggttgtaacgacgcaactga

SEQ ID NO: 15144 - DNA, 422 bp, Saccharomyces cerevisiae
gttggggaataagaacatgtatattttttatatacacatatattacacaagtaccagttactatcataattaattaattgttctctatttatacatatttgctcttccgtattaaatcatattaaacagctttcagcaggtgccggcgccgcctctttttattttcaaaattcaaaatgcacataatgagaagatgtgtgtgatagttaaacccagatcaaaaaatagctgaaacgttcgtttcagctccgcaaatctatattgctaattaaaattattcatcaatatctacttctgtttcagtttttttcctcttcttcctctgacctttggatatcataataatgtcagttgaagtagataagcaccggaacacactacagtatcataaaaagaacccttactcccctttattctcccca

SEQ ID NO: 15145 - DNA, 496 bp, Saccharomyces cerevisiae
cgtttaggtaatcaaccctaggaaggaaaaagggaacggaaataaagacgcaatacatttggttttggctaaaatatatagaacatgaagtgcaaaagaattaaaggtgcattaactatttaatatgtatgtgattatataaatctaaaatctcaatgtcgtaacaatcactgttccattaaaaaaacgggtaaggtggaaatttcagttttttttttttttcttttcttttgcttgatcggctaaaaaatgaaaattttaaactcatctcatcgcagataaccataacacgcttaacagatagaacgttctaccactaaaaaaacatatcaaacgtcacttttttgaataagtaataatagttaaggaggaagcacaagacgcactgaatataccaatcaagggcatcaacaatgggtagaagaagtagagcagctatgctcccaacaaatatcattcttttacagaatttggtaaagcgtgacccagagtccta

SEQ ID NO: 15146 - DNA, 496 bp, Saccharomyces cerevisiae
gctcctcaagctttattgttccagcattaatgtaaaagtcttttcaatattttatgtacggcaaaactttttaattccattttttttttttttttcgtttcttttcttattaaattaaatataattataattataatattcctatctttacaaaatcatattagtatataattctagcatgcggatggtctttaaggagcggccgttgaaaaaacatgtcaaaacggaagataagtgaccaagataatggcaaaaccgcgtggaagaaaaggcggcaggaagccttcacttactccacctaaaaataagagagctgcgcaacttagagcatcccaaaacgcatttagaaaacgaaagttggaaagattagaagaactagagaagaaagaagctcagctaacggtaacaaatgatcaaattcacatattaaagaaggaaaatgaacttctccattttatgttgaggagtcttttgactgagaggaacatgccttctg

SEQ ID NO: 15147 - DNA, 402 bp, Saccharomyces cerevisiae
tgttgctagaagagaatatacaagaaaaatagtagaggctaaataaaaaaaaagtagcattaaatgttatggatgattgggatatatatgcaaataacccaatcttacatatgtttctttcaaatatatgagtatatataacgattaattgtttttttttattgggtttgttgatttttccaacgcaccatatgtgatatccaaattagatatccaagaaagtgcaacaatcaaaatgaacaatagcaacgcagaaactattaaacacattagtagtccttcagtccagatggagcttaaaatatcatcgtcgccttctttacccttgttgttatcatgatggctcaaagtctcttctgttgcatattcatcgtcaccatcttcatcttcaaaagcccaacc

SEQ ID NO: 15148 - DNA, 445 bp, Saccharomyces cerevisiae
taaaatgctttcaagctggtcttcatgatatataatcctttataaagcaagatacatacctccattctaatttactcccttctatgtttacttcagccctttttaatagatttcgtaagttttggttgaggaggctttctgagctttacgcgactttattgatgacgaagcttcactttattataataatgaaaaactgcgcagagaaactatcgcaaaacgaaaccatcttcttaccctaaagcatcctgtttctgaaaaaatgagagcatatggaaagaggggcccagttctcagaactccttttagatctaataaaggcttgccatcttcttccgatgttgaatttagtgatgacgatgtaaactccgtgattcctgatgtaagttctaccatttcgagcagtattgcagaccacccgatagagggattattggacgagcct

SEQ ID NO: 15149 - DNA, 456 bp, Saccharomyces cerevisiae
actaatgattcgggtttcgcatatatacatggctttggctacttttaggtttatagttcttgctgtttatatcactaatatttagtatatagctgcgaagaaagaaaaagaaaatattcacctctaggagccaaaaacataaaaaaaaaaataattaaaaaaaacttttattgaatgcttaattatttagtgacgcgattacctatataccaggttatttattttttcttttttcaaaggaaaacaatacaaaatattactgttaccatttttgttactattattattgtctttattactattatttttctatcgttgctataattacaatttgtttactctacaacttaaaaggagattactccagacaacgagttttgttttatgtttcctattcttttaatcttggaatttgtatgaaccactttctaatgtaatggatccacctctgtaaga

SEQ ID NO: 15150 - DNA, 459 bp, Saccharomyces cerevisiae
actattttcttactttattcttttttcatatgatttcttatttaatctatcctatgtttatttaacttttgcaaatctgtattatgcttgcttaaatatgtctctatagtttccaagtataaattccacgatataattcctctccttcatgtccacaatatctttctcgccgtcaaaatcgtggataagactcggtgcaaagaccaacgacaagttatgtaagttcattaaatttctttcactgcaccttcgaactttgccgatatgtgctgccaatactttcaatacttcctgatgctctacgggtaaaattttgaaaatttcaagtaggcttttgagcaccatttcataaatagtcactttttgtggtgaatccaaaaacttgtcgttgtttaatggtagcctctcaattagttggttatttctaactagatctatcaaggcatcgtatatggaaaa

SEQ ID NO: 15151 - DNA, 407 bp, Saccharomyces cerevisiae
taatagctaacgtcaattccaataaaatatatagcgagcgttttacattaatccacctcgactagacttcaaattttcacttttatatcttacctttataaatttctgttctcaaaatcaaaacaattataaaaaaatgctatcattaatcttctatccttgaattaacattatatactctccccccactacattatattttgattttacatataatacaacaaaccttctcaacttaactactctctttcctcagtatctgtagaggaagaatcgtcgccaaaggctatttctctaatttgtacaatccaaggatccatcaacagctcaaccgcactggctctcttggaggggttttgaataagacatctttccagaaatttcataccagcagacgacacttcatc

SEQ ID NO: 15152 - DNA, 465 bp, Saccharomyces cerevisiae
acagggaacgggttatataattttaaataatctgtattttcaataatatttttatgtatgtttatttgcacgtcacgtttgtgttatggaagacatcattcaggaagtgatacatacaatagtctaaaaaaaaaaggaacattaacggctgaaaagtcagaaatgaggtataaaacggtatttaagagaattgattaaattgtatgtatgccgtccatttctgtacgagcgttagtggccaaaaaaggtaagaggagaggaaaataagtaaacgaacatgacatctggtcatcttaagttagagaatttcttacgcgtatctggcaacttcttctgttctcttttcgtgctccttcattttcatataaataaagttctttataacctgccatttgtctctatattttttggggacgtatttttcaaacttgacaagtaactccaaaacagccacttgtgcgtatg

SEQ ID NO: 15153 - DNA, 428 bp, Saccharomyces cerevisiae
tgaaacaaaccagacgaaaaaaactggcttcatttaactacatatacatatataagggtttttctgatttttattttatcccaataaagtttgatttttttttttttacttttattatgcactggggcgaggtttttaggccctttcttttcttagaggaaatatatacacatgttctcgctaaaatcagttaaaaggtccgattgagatggtactgtcaaatgttaaaatcttcagattaaaatcgcatagagccttcagaatcggtcccatgattaaagcagtcgcaggaaatcttttggtaaagagattttatcaaccaaaattagaaagaattccaccggcttcactgcttttgaagcagaaaatacggttagctcaaaatggcagtactacatctacagaaaaccccatttccttctcacaga

SEQ ID NO: 15154 - DNA, 421 bp, Saccharomyces cerevisiae
tgaattcattggaaaacacaaaatatgttagaataaataaggattttttagtgtttgggctgtatatcttaagtaagagtattaacttacaggaatactggagttctcgttgaatattagtgattgttttacgtaaatttcatttatttaaagcttttacattagaagttgtttgaatgtaagtttaggaaagcactacatagcttaccaggcaaagcgtaactgagaggcagtaaataccggtggtttccatatgagtctattagggtctattgtccttctctttttggctttaagtcgattgtacctatctaaaatatcttcattcaggaaaataatatgctgacccttgtaatatcgcaggatattcagtgtctttgctgtgtgtaatatatctgtagtggtcatcgaagtcatggag

SEQ ID NO: 15155 - DNA, 478 bp, Saccharomyces cerevisiae
tcagcggtataaggttgatatcttataattacattatataaaatgagtatatatactacatgtttatgtatcagcatgtcatagcttagtgtactggtcttggaggatatttatttctttttactatggggacatgcttgtatggcaaaccacctctgtccttccttagtaataaactatttttaccgaaagcctttgctatagtcggggttgagttcgtatttccatttaagtcgaattctatgggttctcttggcggccttttattcaagtccgggttgaaatgattgaaattttttctatagatcaacggggtccttgtttcacaatgtattgggccacctttagtctcggatatatccatatagtcatcactgtttgtgttcttcagaaacatcaaatcaagaggttttaatttgattgacatatcctcgaacaatataatttccttcggttccccctccttgaatggtttcag

SEQ ID NO: 15156 - DNA, 484 bp, Saccharomyces cerevisiae
tttgattgactaaactaaatacggataagtctgttgtataatatataacatcctgaaggcaaagtctttgtaaagattgtgctttatagaacggtcaatatcgtcatggctgatgctactctgttcatcacttctcttctttatcgaagaccgggtaataataaatatccgaatttttttcaaattttgaaaactcactcacgtcttcctagaagatttcaaatgcattaattcatcaaaattcaaaacttaacaacacttgtgaagaaaagtcacaaagaagtaaacgatatgctggagacgttgcgcggaaataagctgcattctggcacctcaaaaggcgccaacaaaaagttgaatgaactcttggaatcgtccgacaatctaccatcagcatcctctgaattaggttcaattcaagtaagcattaatgaattgagaagacgtgtttttcaattgagaagcaagaacaaagctagcaagg

SEQ ID NO: 15157 - DNA, 460 bp, Saccharomyces cerevisiae
atcaagggtgcatggtcgtacagaaaatgaagaattagttcaaaatgccagaaaataaataatagtgtacatacttttaaaaaaaaatcattgaattattctgccaggattagctactttacgcataattctaacgtgacaaatgttgtttccgctttgttaattatactttatatgattttgttcaagccatgtcaacctcatttatggtaccatcttattcggctttatcaaaatagtatataggcatatacatgaaatatttttttctttttctaaaaaacctacatgtttaatgtgagatattacgtaaatcagttggacgtatcatatttcctcactaattcatcgaattttgcgtcaatttcttggtgatgcttgatgaatgcatgttcgtgatccaatttaaccaattgatttgttaaatcttcagtatcaagaccttgcataagagcaagcg

SEQ ID NO: 15158 - DNA, 462 bp, Saccharomyces cerevisiae
atttctatagcttacaaaatacgcgatgtttttttgatctagaaatcttatttatacattttatataatattataataatcataatcataattattcatcctaactaacttcgttctgtttcagctacgaagttgccttcattatcgctacgttcgtgttaattggtgtttgataccatagtcacttatgacgacgtgcagaacttttttttttgacggatattttcccctcaatatgccgaggatgattactttataatttgccttctttcggttccttcttctttttaatttagctgacgggaacatgtgtatataccccagaagaatttaaacagaaatttttttgagcattttacgaaaatattaaaaactagggctacagatatcagagaaaaaattacttatatgatgacaataacttaatatcacagtcactatcgttctcgcctttatatgcgc

SEQ ID NO: 15159 - DNA, 464 bp, Saccharomyces cerevisiae
tagctttagggttcttccattggatatccaaaatagatataaaggtatatatatatatatatatatatatatgtttataaagcaaaccgaaagcaaaaatatctgtataacttagttacaagggaagggaagagaatgcattggttaataggaacagacacttcgtaaaaagcttcacaatcattaatgttaatagaactatcataatatacaaaaaatctcttcatacgatttttgtttgatgagcatcctcagtcaagatgaataaaataatctctccaaataagccgcctctttttttttgaattacacttctatagcgtacatttccatgtaagaagattgaagtttcaaacaattgggtagcttaatatttgtcaaacttcttggtaggtgttgtgtttaagaaaaaggaggcaccataaactattaactttttagcttgcctcaactgtcaaccgaat

SEQ ID NO: 15160 - DNA, 475 bp, Saccharomyces cerevisiae
tttttttcggttcatcctaattttttttttttttcaaaagggatctaaacatttatccgttgttataagtatattaaaatatataaatgcattcaaaggtttgctatttcacgtctgcttacacttttgttcgatccatcgtaggctatttcagtacctggtacgtgtcttgcaggtattccaactgttttttaaagcggctgtaatctctggaatctttagatatacgatcccaatccacttccttcaaaagtttttcaaactgtttgataattgaatgcaattttttttttgtttcttcattttctgtcttcaatgactcgtaattttgttgaagacttttgttcctttcatcaagcttctctgatgaaaatgtggcaatatttcgttctcttattgcattctgttcgtcgataaaatttttaatatatgagaaatgctcatttatgttgttaattagcgcaacagcctttgt

SEQ ID NO: 15161 - DNA, 445 bp, Saccharomyces cerevisiae
tatctacgtacatgtgtatacgtgccaatatttggacgcatcttattttacgcgcttgtgaagaactcactaccttcttgaaggaagtaagaaaaaattttcagaattgttgatagtcgtatatcttccattataactattgttagctattaattcagataatgtagataagattgaaaacataaattcatcataaaaaagaataggtcttttacggcacccgttcagacactttgacacttcaaagtatatgcatcagcacacttctgaccattctacgtattgtaacagcaacatgagttctttaaaactccaattgacattttcgtaatgtgttttgcatatcatctaaatttcaatgacagatttaaaaagtcaagtaattaaaaattttcataagcgtgcttttttatagtgcgaagaacggcaaaggcaaccttaagaa

SEQ ID NO: 15162 - DNA, 429 bp, Saccharomyces cerevisiae
tcgttcttctaggaggatctgtacatatatcctagtctagtctatctaaaatacttagtctttctaacagcatatcctttgaaatttcttgtatttcccctccaataaacatctcgtccattatcatatagactttgtaaaagttgaatacgatatccagttcacagacattgccgaaaaatgcatctagcacctccacaaacagatggatgtggcacaaatatatgggttcatcgtcaagtaagtccacacccatgacaaaatacagacccgcatacctcctgtatatgagtttcgtcgaatcggaaaactctacgaagttactctgatgcttatgatctctggaagatatgagtctataaatctgcgcaatggcatcctggctacgctgaggatccgaactgtgtacatcgaaccatctcaccaacc

SEQ ID NO: 15163 - DNA, 459 bp, Saccharomyces cerevisiae
agtcatatatattctttagttattatcttattttatttcgatcactatttacagataaatttttcttttatacatttttggccagtgaaccatcaactatattttttgtatcttcacagaaatgctttattttccttgtcggatatttttgcctttgcagatgctacattttcattagcaatgttaaccaaggaatgaagatcttctttatccagcaaacttccttggataaatttagctgctttttcagatccattcgttgacagaattgcaccaataaatgcgttcaagacactagcaaaaatcgtggtttcaccatttatgtggccatcttttattgggtctctcatcttccaaaatatgaaagggtctagattatgtaatttaacgaatgtgcatgctgtgtttttggacgttaattccttagcgaattttgttcccagattgctgaactgcaaa

SEQ ID NO: 15164 - DNA, 436 bp, Saccharomyces cerevisiae
tcaagaaattaatactccaccttatatatatacgtaagcaaagttttatgtaacaaaaaaaaaaaaagaactaatccaaccttctttcactttcaggtaaaacttgactgagttcttcagcctctcttctacctctcttgacatccaaacagtttagcacaggcaatgatagcatcaaaagcaaaaagaagaaataaaacgaatagcgaatattatgcgttttatcggtaagcagtccaacaaggaagggtcccaggatggacgaccccttatctgtgatactgaacatactaaaaaacgtggattcttttcctggaggtacaatcaaactgaaaactgatcttgaaaccgcggacaggccacctagtgataatccataccaaatggccaataagaacatttcaaacttatgctttaaaccgaacgcattgaagaa

SEQ ID NO: 15165 - DNA, 465 bp, Saccharomyces cerevisiae
gctgtataaacagaagtccttactcagctgaaaaagagaagcaagatttatatgggattggacgatgaaaagaatattagatacaatgtatttaagaaagaatacaataaaatatatgtatattctatctctaataacatagatttactgatataagatataagactattgttggcaacagtacaggggaacctttttttttttttccaaacaactcgaatcgtaaaccttaatttaatttattcaggggagattcatgaacatttttttcctcgaacagtatggagaatttttgcttagttacatgcacgcaagcgcgggtatatcccgcatatatttcagttgtggttcatatttgacctaacttgtcgagggagcgtcaacgttaaccgtacctttttcatttctagtctatctgtaggttaattactattgtcattaacatcatttctggggtgaagccta

SEQ ID NO: 15166 - DNA, 415 bp, Saccharomyces cerevisiae
gtaagtttttagtagtggtacatatataatattaattcttatatccgtcttttctctttggttattttctcagcttcagatattcaaggaaccgtatttttgcgtaatagcgaaaaattgtttatgttacataataagtgaaagctggaggagcatatgtatagaatcgaagagaaacctgaacaatttttcggtattagttactaaaaggctcacatatacatgacaaagaggagaaacctctttatggttggttcttccttcacaatagatcatttacctccagaaatatggctttgtatttctaagctggtcgggacgtctgacctgcataacttgtgtttaattaacagaagattgtatttgacaattacaagtgatgaaatttggaaaagaagatgctatgaccgatgga

SEQ ID NO: 15167 - DNA, 498 bp, Saccharomyces cerevisiae
ttctaatctctgcttttgtgcgcgtatgtttatgtatgtacctctctctctatttctatttttaaaccaccctctcaataaaataaaaataataaagtatttttaaggaaaagacgtgtttaagcactgactttatctactttttgtacgttttcattgatataatgtgttttgtctctcccttttctacgaaaatttcaaaaattgaccaaaaaaaggaatatatatacgaaaaactattatatttatatatcatagtgttgataaaaaatgtttatccattggaccgtgtatcatatgatcatctcttcatcgcttttcagttttataggtttatgcaattgcccttcttgggaggatcttgtagaaccgccattagaatttgagtccggcgttttgatacccttttccccatgtaaattggtgccctctttactctcaaattcgaagaatttatcaatatcttctatgctcataccctttgtttctgggaaccaa

SEQ ID NO: 15168 - DNA, 464 bp, Saccharomyces cerevisiae
tagatgaaatgaaaatactaccaattttttcttctcttctcctcatctcttcatatagtcttatatatcatatatgctattattatgtgtgtttaattatcatatcattttaccatctttttcacaggcggtgtctgctggaaaacacacttcatgctctaaatttttcaatttagcagagaatacgaattttgcatttcaaggtttgcaaggtcatagtatatacagaaataagaacgattagttaaagtcagagaaaaaaagcaatattgttatctgcaaaacttcgaaaagttcagtacaggtctgtgttaatatattttttcatcatgttaaattgaaacaagagtttttcttttaccagcaaaagcaccgtctagccatttcaaaaaaaaaaaaagaaaaagagaaaaaaacagttgggtgaccacacctatcaatttttttcacaattgcagctgtgg

SEQ ID NO: 15169 - DNA, 448 bp, Saccharomyces cerevisiae
tagatggctgttaaaaagaatggtttcactgacgaagtttttatcgctattgatattacagtatcattactgataaacaccttagttcttgcagaactgaaagtgataaagcaaggaaacagtgcgcagtagcaatctcttttacgattgttctgcgtttgccaaggtattctcaaaatactttaagtactaaaaacctaaataatctctatacatagaactttgaattttcattgtttaaaaaaatgtacggaactgctaagaaaatgtacaaggtagtgaaagcccacagagaggtacatttcaagtgataaactttgctttttagatttgaaaatgtgaaatcttaccactctttaaagcgaccatactagtaataacgcaggaatagtaccactaaatgggttgccatcaattttatgcgctgtaagctgcgcatatgtttcct

SEQ ID NO: 15170 - DNA, 404 bp, Saccharomyces cerevisiae
gctcagcagttcctctagttttatatcgtctgtccccaattttgtagtagttattgtacacaaaacaaatatatacgtatatgttaatatagattctgatttactttctgtctccatatgggttatggtttactgtccatatggagccgttgagagcggaaacgacttgtcttgaccgggttcccgaacttatcaataggctccaattcgccttcagtgtgtgcggcgggtgatgatgattgccatttcgacgcggtagcttctttcaaccgtctgtactctatagcaacctcttcctgtagccggcccggatgtagtgctacttcgtcctcgtcatttgtgtaactttcaggaaattcatgctcaatgatatcattcataacattgccatcattttcctcctc

SEQ ID NO: 15171 - DNA, 430 bp, Saccharomyces cerevisiae
taaacaactgctttcagtgaaccagtgtttgtccctaatataataatacgtattcaatttatctccggagaggaattttttttttttttttttttcgttcttcggcgactataccgaaacaaggcttgaaatatttagaatcaaagaaagtttacgtcttgtaaattagtaaatggtaacgtgaaagaagtagacgtaagggtgcagtaacagtcatttgagcttgttgacctaccaattaacacaaaaaaatgggcatgttttttaatttaaggtcaaatataaagaagaaagccatggacaatggactaagcctgcccatttcaaggaacggtagctcgaacaacatcaaggacaaacgctcagagcataactccaactcattaaagggcaaatacaggtaccagccgcgctccacaccgtctaaatt

SEQ ID NO: 15172 - DNA, 426 bp, Saccharomyces cerevisiae
taggcttttaatgaggtatgcttttaaagatttatatattttttatacacgctatatacacaattttcgctgatgattttgttttattattgatttttaaattaaccgtagaaaatactaagtggaaagatccgatagtgatgagataagacttttagttatctctgtaatggtgagttttcgcacatcttgcaatattaaaaatataaatcaattcttcaaatgtcacttcatggtcgggtaaccaaatatgatcttaaaaaaaattaagaaaaaaaaaaattgaaaattttgagctaagctcatctcatctcatcggctgtaatcagtaacacatcatttattacatcagttacaggtatcaacatatatcttcaaaaaggggacattatggttttgaaatctacttccgcaaatgatgtttca

SEQ ID NO: 15173 - DNA, 436 bp, Saccharomyces cerevisiae
aatctactgcaattttttacttttagtttgttaaattttagttttcgtcatatatataaagtttaaaaaggtacaaagaatgcagtaataagaaatgtaattacatgagggcagtttaagtgctaccttttaagacggaagaactaataccataaccgagagtaattacgcagacaaacgctaacaacgaagcaggaacacctctggagataaaagcgcctacagttagccatctattaccctttttatcggtcatagaaatagcagtaacgtttggaaatccagatgaagccaaccccataccgcatgaggctaacaaggcgcaaccgaacacaagaattggagctgcctttggatcggataatttgtcaccaacttcttgcaccaagggaataatgatgattgctgacacagtatgtgagacaaaagtgcccac

SEQ ID NO: 15174 - DNA, 439 bp, Saccharomyces cerevisiae
acatggacatttccttcttacacctatataaacttaagtatattcaaaagtgaatattcattattctttataagattatattcggttaatattaaattacaagcctcaattaaaaaagtatatatttgatgaattataaatgacctatatgcgaaaaaagtggagcaataaaaaattgatgaataaagggtgaaaatgtgacaatgtgaatgttttagttcagaaagcttctttacttcttgacctatataatgagtagccctcctcattgcccatatcattctcttcatcttcatttcggagtcttcttcatcgcttgatatctcgttatccattcgatcatcaacactggtgcctagtgccacttcttcgtcttcgccattattatccaatgcggataaagaattgaaaagaatagtcttcggtcttggtggtgttt

SEQ ID NO: 15175 - DNA, 471 bp, Saccharomyces cerevisiae
aagggaaaaatcgaattatttacacgaatatatatatatttcttcttcttttacatagtttataattcatacatagtgggagctgatcatagtcttctcatctttggtgatcttacaccaccaaacttcaatttggtggcatcgctgatcttcacaacctttttcaccacactggccccttccttaccaacaagagcggaaataaaagcagctctgcccttcccaaagtcgtccatcaccacttcgatatctttgttcagcatgttcttttccttaatcaattcaaacattctaccactggtttgaaatgcagcttcatactcccctcttgctgccttcctaaaccctaaacaacctgtagatagcgaaatcttcactttctggggtaagttcaaatagtacagcattgtatcattatacgtaagtcccttattcttatgaaagttcttgtcctccacaacgcttgaaaat

SEQ ID NO: 15176 - DNA, 430 bp, Saccharomyces cerevisiae
gggtagtccgttgtaaaatgttgaatatataccagtatatagtaatatttcttaaaatgttcatttgtgatggtgaaaaagaatatgaaagcaatgtcaggatgacaccgtctacagggaatttgcagttgctcttcttcgatagtacgtatatccaattatccccaaaacgaacaaaagattaaaagcggcacaatatttcgtaaccataaaagtatagctgtagcaaagcactccctttttacagttcccatcatcatctcctgtatttgccttgaaatctctacctaatatatcggtaaaaacactcactgaaaatacaccaccagtcgttaaaacaccccacagcgtactatacccatttgtgccaaatctatctgctactatggaggggaaagtaccaaatagaacgccaaaagaataaccgaag

SEQ ID NO: 15177 - DNA, 403 bp, Saccharomyces cerevisiae
atagcactataccttgctgaaataaagcgaaaagaacatttaatgaatatataggtatcgtatatgtactgaataaagtgtttgatacagaatgcaaggagataatatagtatggtatataacctcgtccttattttgaatatacatgaaattacaacgcttccctagagaccgaatcaaacgcagggattttatagtaaatgataatcaatcataaaatttctctcaatggaatactaacgacactactctcatcgaatggggtatcgctgttctcaaaatttaggtagctatgatcatgcataggtcttggtttgaagatgacttttatcaggaatagtatggcgaaaagagttgcaatcccggcaacaatcaaataaacaatccctaatgcctcgtttcc

SEQ ID NO: 15178 - DNA, 491 bp, Saccharomyces cerevisiae
tagtaaaggacgctaattgaaggcaaagttttactagtcggcgggaaaaattattaaaaaaagcacttcctgaacgcgacgctgaataacttataatacgttacataattgtataccgtctagtaaacttacatacgcttgtctatcttgtatgctgatgcattttatcaaatagcgttatttcccgcacgagccaattttttatcgtgccccttcttacggttatggttagctctagcccctttccttttttcattcttagcatgctgtcttttcttctgttcagtagattgaggttcatgtttcttaatattttcagattttttttgtttggcttgttctttgacgacatttccatcattttggctatcacgattatgaacataagacgttttccctgttttgctatttcctttgaacataaacttcttttctaaaagtcttgctcgggtaggagatctttctaacatccgacaccaaccttcgatttt

SEQ ID NO: 15179 - DNA, 428 bp, Saccharomyces cerevisiae
cgcgcgaattagtttgtaaataagtcaactttttagatgtgtaacctgataatttttttttttgatgttcgacatcattatttctgaatgaaaacgtgaaaagcttcgccaaacttaaaatggaaaatttcgaatggaacaaaatataatcgatgcgatgaattaaaaccttggaagaagagggttaattgttaaaattacatatataattggcagacaagaataaaaaatgcatgaagtagtaacgatatcggtttcgcagagagcaaaccatttgactactcaattcttcaatatacaagagggctatttacaattgtctaaagaacaacaagtcaatgactccaaaatttttctgaattcggttgtagataaagtttcaaaaacaatttcatatgcaccacgtgccttactttgggatgcccgta

SEQ ID NO: 15180 - DNA, 477 bp, Saccharomyces cerevisiae
gtttttctaccactgctattttcttcattatctatgtatgtgtgtatacatgttatgtattgggtgagtatgaggaagaagaagaataacaattgaaaacgctggaaaaattaaaaggggcggtggtctatctatgcaacgctccccttttcgttacatgaacacatcaaacttgtatatcctttgagtgttctttaatcaagtcatcttggtattttagtagcgtttccactactttagggacaaattcagacctaaccaatccatcaaaagcatcaaacccttgcgacaaaatcggaatatcagactcgtcatgcataaactctggaatttctagtttcccgtccgcaagtatgccgtcatcatcctcgtcgtccttattagtatccaaatttgtcactttgacgttcatcgacaactgtaagtcaaagtagcaaatcggcttgcccttcctttgagatacgttggagtcaccgg

SEQ ID NO: 15181 - DNA, 430 bp, Saccharomyces cerevisiae
tggtgaaggatagatgcagtaatattatgatttttttttgttattttatagtttctttacacatatcattatatctatgtaaaaacgtagttacttaggaagagagaagagtgatgatattatgaattgaaaaataaaaataaaatgagtatttaatgaaggtgggataaaactcttctaaattttttgagtaccgtagcctttaatatccttggcgaagtcccatttcatgttttcaacttgcaagtttttcttgaaagttaaacctgtgttcttatcaattatggccagtgagaagtttctagaagaacgggcatctctataataaagaactctcattgcatttacgatcgcctcttcagcaacctgtacagtggtctttggaatatcagattctcgatctacaactttccttaacagtgggtttgcc

SEQ ID NO: 15182 - DNA, 462 bp, Saccharomyces cerevisiae
acgccttatacatgcgtgcagctcagaattgttgcgtactaaagttagtttatatgtataatataaaataatttatcttaatcgttaaagatgatatgaagttttgtctttattgctgtcattgttatatcgttatttgtggaaaggctacacattattacaagtcatcaaaagccacatcaaacttgaaatcgtcaaacagggtacttatgagaaaccccatgtcgccttcggagcaacattcacaacataattctacattggccgcctcgccatttgtttctaacgtatctgcagcaagaacacaacagagtttaccaaccgatgctcagaatgatcgtttgcagcaaccctggaacagaaccaatacggctacgagtccctaccagtcgttagcaaatagccctttaatacagaagttgcaagcgaatattatgactccgcaccagccatctgctaatt

SEQ ID NO: 15183 - DNA, 492 bp, Saccharomyces cerevisiae
cgcgaagattaacttatgtgttttagtgtgttttcaaaaggcatttctctgctcacgtttaataacagggtgacggagcttaaacaagtaaaaattgataaaagtctgtatcatataattttgaataatctatactagcgccttaaaaattacataaatgtctaatcatataacgttaccatttcgattagtggtaaaccttttgattatgaaatggataactgaccaacatcttctatcaagtgcttcattatatgtaaatttcgcaccgtgaacttctcgatacttaattcttttgaacctcaaaatatctttagcagtgaccaacccctttaaaattccactttcctctacgatgatagtcttacaacctagctctttaaacatacggaataacaatgttactggcaccgccttcttcaccgagattggagattcattcataatatccttaaatccgatgcagttttcacgatgtcccaactcttcgtt

SEQ ID NO: 15184 - DNA, 411 bp, Saccharomyces cerevisiae
gtacggtttaacggaggaaagaaaataaaatgctgatgttactattagattaaaagtttatatattttccgttgagactatttaatttgtatatacaaggccatgactttaatattatcaagttttcattcttgctgcttttggatataaaattaatcatggggtttaccgttgatcctatcatacagcctagcggcgtgatagttaatattgctcttttgaacgttgtttcttttgccgagggcactttcactagtgcaacttttcaattccgttactaagccagcacatttagggctcatatgaccatatgaagaccagcattgtaataagtttgacattaaaacaagacatttgttcgcttcttgcctaatgataggtttcttcacttttagtctgggaagagggggt

SEQ ID NO: 15185 - DNA, 411 bp, Saccharomyces cerevisiae
tttattttcttcgtcagtttctctgtacatatatatgtatatatttacttattataattcatagcaaaatatatgtttttttttttttcttatagtgagaaaaattactaatgatcctgagatcaatttcactgtagtttttactatagtgcaacaagtatgttgttcttaataagtgtaatgaaagctctgaggtcaagttttcttttttacagaaaagttatattggcctatttcataaataactggcggcaagaagctaatgtaatataactcgatatcgcttttaatgccattgtatgtcatgaaaagaaaataaatagaattgagatgaatatatattcttttttctagttttgttctatttgtacattgatttaatttaattaacgaatatacaagggttttgcg

SEQ ID NO: 15186 - DNA, 451 bp, Saccharomyces cerevisiae
ttagatagctaattgtaaagggttggttcccgcataacatatatacatattcacatgtttctcattttttatatttgaaatcacatatggtctttgctgattatggattggaaaacggagtaaattagtggcattattggggtatacgtgcatacataaaataccgttatatatctatatatatggaaaaaagagacttaaatgaatttttagagtaggagaagaaggttgaagaaatgaacaatcgcggcccttcagttttctttatttggttgtgtctggattcatagaggttattgtagagtttgaatttgattttgaacttggattcgagtttgtgaacgcagggctatttttgatgttattattaatagtattcttgtgtttattagtattattgtgattatcgttaaccatgttggcaattgatggtggttgtgccagttgtgac

SEQ ID NO: 15187 - DNA, 486 bp, Saccharomyces cerevisiae
aggttggccagcaaaatacaatcttttgacgccataaaatttgccatcagagtagcttttaaatgtacatagttctaaagcacgcatatatatttataacgctaagatgataatgaaaagttttatttgcaaaagggatcctgtatttcaactttccatacatgaaagattctttggccattttcttaatccatttcatattttcatctgattttttttctgttttccacttgctgctcattatttcattttataatttttgcaaacatgcaatatttcgccatatattgagaaaagcaattcttcgttgttcccagtaaagaaagaacaaatgcagatttctaccgccaccgctagattaagaattttttttggttactgatttgaatcacatacgatgagttttagacatttcaagaggagacttgacacaagctcagcagatgaaagctcttcggcggatgaagagcatccagaccaaaacgt

SEQ ID NO: 15188 - DNA, 498 bp, Saccharomyces cerevisiae
atgtactatacacatagatgctaggaagatgatgctagaacttgattaacaattagttaaggaatatataatcacacttctacataaatttgctgttttaggctcattccttctttctttcaccctttagtagcgaagtacaccatttagctgcaccaacagtgttgctagatatggtgactattgtgaagaagggtattaactctagtagaccggcagacataccgaaacatatgaaacttgcgtaatgctcgtactgaaaatctttggcctgtttcttactgaatccctttagtaaaaagtacctctgcaaataggtaaaggttctttttggggccattagttgatttgccaagattggtcctacaataggaattagcgacagtaatgttagtgaagtaaaattggagactttaaaaaacattctgaatagtaatctgggaatcttaaaaatccgacttccctttattgtgttgaaatttctcaccgcatcaggtt

SEQ ID NO: 15189 - DNA, 406 bp, Saccharomyces cerevisiae
actttacacaaaacaaaggaatgttgtatccatttatttactgtatttgaatgttatagacctgctagaatcactcagtcatttgtaatatgtaacaacattttgagatttgagtcgtatatttttcctcttgcgctttaaatacgaaatgtaagaatgatctctttcatgccagagttcatcttctgccaaaggttgatcaagctttaaatctaaaatccgtgaggtactcacgaagttgaacatttctatccccaaggtgtccaaactgtggttgatatgttctttgaatggttgcttattttccacagctggaagctcgtctaaccagctgaaatcgatgctcactcgtttctgctcttttatttgtcgtcttatggtttctctcaattccatgatttccgaa

SEQ ID NO: 15190 - DNA, 450 bp, Saccharomyces cerevisiae
gcataacttgagtgccagtgaatattaagtaatcatcaaagtatatgtgtaattgtttatactcttagtaaaggatgctccctacaaggtggctcttttcttactaagcgcgttcagtttccagccagccgaaagagggatatcagtatataagaaagccattcgggggatgaaaagctgacaagagaataacgaggaccagtttttatttgttgtctagcaagaattatacacgcacacatacacgagagtctacgatatctttaaataacacatcaataatggtcactcaattaaaatccgcttctgaatacgacagtgctttagcatctggcgacaagttagtcgttgttgacttttttgccacatggtgtgggccatgtaaaatgattgcaccaatgattgaaaagtttgcagaacaatattctgacgctgctttttacaagttgg

SEQ ID NO: 15191 - DNA, 447 bp, Saccharomyces cerevisiae
gctggttatgaatcagcataagacttacgtaactgtttattttataattatttgtataatgtactaaaaatataaattcaataatctccacttctgcaagaagcaaatgtactatgaagtgaatatttcaccttgtaatgatgggtggatttgcattcttctttacctttaaaaatcagtaaatatgcttttatctattgggtctgtatatgtttgggaaagtaacccttcttaattgatttgttccaacaatgaatcaattatttcagctgttgaccttcctttaaagtcatgaatcttttctctcatctgctcgtaacataatctcagttcaagaccagttcgaggatatccgggcttgtaggtagctatactgttccagtcgatatttgaataggacgttttaggtagctgtttcaatcgttctagcagccacttcctttcaga

SEQ ID NO: 15192 - DNA, 407 bp, Saccharomyces cerevisiae
gctgtgcaatgtagtcacaataacactcgttcatttgtatccattgcgaatgccggtacatcggaaaacaggataggacctatttaattatatagtatgaagtattcataacttcttgaggcatcaatacatcatattccatgagctgcgtggcattcatactcattgatttaaaggttttttattttcatggaaaagattaaccgggctgaacgaaatatattaaagatgctaaaacttatgctttcattgactttcaatagtgtccactaaccaaaaaaaaaaactactctaacaagggatccccatggattcaaagccgataccaaacagatattactctgcatagaattcaaaatattatccatataaagatgggaaagaattccaaaaggaaaattctgctc

SEQ ID NO: 15193 - DNA, 493 bp, Saccharomyces cerevisiae
tccacttgagaatccttactattactgaaataagcacattgcgtttagaatctttacatatcaaatttaaaatttatataaacaatggagattcacttttttaaccttacgccatttcgtatctgtcaccaacagtatggaaagtagtcaaatatttgttaatggcattgaactcttgatcggtaagtttggttttctgttcatcaaagttttcattaaccttggaaatagaagagccacttggaattgggataaatttggcgccactgtattccggaactttgttccagtgcttaacccatcccaaagccagttgtgcaagagtaatggagttgttttgtgggcgcttgtcgactatttcttcctgtagaaacctgaccaaggtcaggttttttttcaaagactcgtcgctaaatctctttaacgactttctaaagtcaccctcagggatatcagcgtttgacttcaattgacctgtcaacaatcctctgcc

SEQ ID NO: 15194 - DNA, 449 bp, Saccharomyces cerevisiae
tgatcaaacgatgaggcagcccttttgtgtataagttatgtaaacttttaaggtggtaattgttaaaatggacagtaacacttgtttatttgctagtattccatttagtttaatgcctttttgtatacggtgcgggtagctgtcgcgccattttaaacgatctaatataactgaggtgggcctgtcattgatgcattgaatagacaactcatcaacctatttcttataaaaggcgccataaagcattacaatctacgatcgcgcaaacttttttcttttggccatggaggattcgagattgcttatcactttgattcttgtgtttggagttatatttctgaaaaaattcttccaaagtaatcagcatccctcagcacaacgcttatccgctacaggtgtaaacgcacacggacgtcctcagggctccacgcagaatgccttgagaagga

SEQ ID NO: 15195 - DNA, 472 bp, Saccharomyces cerevisiae
catcgatgttttttgcagttgttttactttatttattattcttatagatttatgtagaactattatttcatcatatgaaagattaaagaaagcagatctcagcttaaataaattatactataatattaaaaaaagataaatattagataataaaaattgaaagacacacgttgaaatatttagtaagaacaacgtatctataggtttaattcttttaaaatatacgatgccaattctttatatagccacgtattaccagaaacctttttgaaatgtacacctgctaggccgacgatacgaacctttacaatgtgaatctcaaatttaataggaggcctttcttttataccagaagtattggtttgctctgtttgaccatttacgttatttatattttgggctcttgatgttgttaaaatatcatcctgttgttgaacataatctaatgacatggaagatagttcccctgatg

SEQ ID NO: 15196 - DNA, 403 bp, Saccharomyces cerevisiae
gtgttcccataggggcgttcaatgattagtatcgatgtgtaaatcttagctgatttttaggcctcaacaaccttcatttactaagcatgtgagtaaatcaaaaggatgacgtcaacaaaaaacacatcagtaacacaaggtataccatacatacatatatatatatatatatatatattatttggtaattgaatattgaaaatgcaagggcttagccgaagctagtgatgataaaaaaaaagtaataccacataatatcattccttcattagtcatttatttggagatcttggtggaggtccacttgagatacttccttgtctcgagatagaatcgccaccactactactactcatacgtcttctaataatagactctcttaaaccgctaggattggtcactg

SEQ ID NO: 15197 - DNA, 406 bp, Saccharomyces cerevisiae
agtatcgctattgctacgtaaagtaattaaaagttaaaaagaataaaactagagcgttttttctactgagttaaggggtcatgtcagaatataacataccctttgacattgtatatatgaattcctggattttgcagtgatctgataaaaaatgtatgtcgaaacctgcaattatcctttcgttttttttcttgtcatctagtgctggcctatcggtatcaaggacatcttttgcgcggatagaaaagggcccatacataccttagaagcaactcaagacaattcatgtactttttaaaccaactaatatttcaagacgtttccgtaatgtcggtggataaaagagaagatatgagcagatctttccaaaaatgtttaaacttgagataccctatcatccaggccc

SEQ ID NO: 15198 - DNA, 499 bp, Saccharomyces cerevisiae
accaatagttaaaaattacatatactctatatagcacagtagtgtgataaataaaaaattttgccaagacttttttaaactgcacccgacagatcaggtctgtgcctactatgcacttatgcccggggtcccgggaggagaaaaaacgagggctgggaaatgtccgtggactttaaacgctccgggttagcagagtagcagggctttcggctttggaaatttaggtgacttgttgaaaaagcaaaatttgggctcagtaatgccactgcagtggcttatcacgccaggactgcgggagtggcgggggcaaacacacccgcgataaagagcgcgatgaatataaaagggggccaatgttacgtcccgttatattggagttcttcccatacaaacttaagagtccaattagcttcatcgccaataaaaaaacaaactaaacctaattctaacaagcaaagatgaagttagaaaatactctatttacactcggtgccctagg

SEQ ID NO: 15199 - DNA, 432 bp, Saccharomyces cerevisiae
ttgaattgaaaatgagacacctaccacgtatgcggcttcaagttgtttaatatgtagctatatatcgattatataactgactcatgaatgaatatcttcctgctgcaatttttctttaaccacatggaaagccataaatcttgcctcctacaaggcctggcttttttcgagggtatcgccaggaaaaacaaatcaataaatgtaaaacaaatagaaccctatttttttttattaaaacctatatttttgtaataaaaaataactattatacaactgttaaagaacccagtaaacctaaatatattgatttatattttattgtgtttttgttcgttttttactaaaactgatgacaatcaacaaactatgatctttcacctcttaatcttctagccaacttgatatccttcttttggatagtgacacgcttgg

SEQ ID NO: 15200 - DNA, 473 bp, Saccharomyces cerevisiae
tctgattatcttgaactggatgtacataaaaaaaaactgtcatataaactcatgtacagctgtgtagaagtgaatgatctttccaagaaaaaaatttcacactgaattgattgaattgactgctcattttatattgggtgcccaaattgtctttctttattgttcgtttagtagcagcaccctgtttgctcgccgactcggccgcatctggaagttcaacatgaaagagtataaactatcgaagaaatctagaacggctttggatcacgggtggcaaagaaatcaaaaacaaaagctgtatcacacgcaatgggtattaacaatcctattccaaggagtttaaagagtgagacaaagtatgttttatacgggtttggctgggaaacctttaaaaaagttctcccttaatttgttcatcatttactaactagtaataaacaattaataaagaaaagcagcgaagattttggcta

SEQ ID NO: 15201 - DNA, 405 bp, Saccharomyces cerevisiae
agtaataataccaagtataaaggcgtgttaatgtattttcttaataaatatatgtacaaggaatatatgatagctttaaatataagaaatataaaatttcacctcatctttatttctgttttaaaaggaaaccgttttaattcatcgatatgccacctctgtacatttcgtcgatgattttaccgttttccaagttttcacataacagcttcaagttgtgtgggtaaactttaccaaaccataatgaatccagcttgttttgcatcttttctctgccgaatagtttatagaaaatgacattaccagcaaaaatatgacccccaatatgagaaattaaggctagattattctcaggaaaaagcttttcatcttgaaatgctgcaattatgtcgggtcccatttctc

SEQ ID NO: 15202 - DNA, 438 bp, Saccharomyces cerevisiae
gactggtgccatcttatatattacctaactactgagatagtttataatccgtaccagccctaactttttttccgacagcattttatttcctttcgtttttttcgacttcgtcgctttctcctccatataaaaaaacatcaagagataaaaactatctttcttgtccttgtccacgttcaatacaacagttacactgcaaacgacattagtgcaaatgcaaactgtagtcaatttgccgtatgcctgacatacaacaggtgttgtatgagtgtgacaaggacactttatatatctttttcaatctctctatccggccttcttggcaggatagcttttcgtttcaatttgttaatgatgataaccaaagatgcatagttcaactgattgaacatactatcgaaatgaagataaaaatttccatcgaaattagtctttcgc

SEQ ID NO: 15203 - DNA, 481 bp, Saccharomyces cerevisiae
ggtttactaaattaaaagaaatatataaaaagctgatttttttctttttttaaatatttcccaaatgctaataaatattaaaatatggcaaaaagaaaataaggtgttgttgcgcagttgggagtaatttaaaaccgtcaacatatgctctaaaaattttattggctctaaattccgacctctgaatgtaattatgttttaaagcgatacgtaaacttgttactgttaacattaaaagataatgcaatcatggtaacataataaagtctcaaaaaattcttaatattaactataacatatgcacttcagaaagctgtttccggatcatatctcattataaaaagctcaatttatagaaaaataatgcgacagtgcaaagtaaacaactaaatttggtgcctacaccgcaaaacgatatcgagtcttagaagtatatacctcaccacgtctcaaaagaacgcagtctctccatccatcacgg

SEQ ID NO: 15204 - DNA, 490 bp, Saccharomyces cerevisiae
aaagaaaatgcgaaccgtagaataacgtatatagaacatataattagtttacgtttcacaaagtattaatattacatgtagctttttcaggactttcgatctaaatcaaagattaaaggagctgctagaggtagaaaaggaaatcattgacttttcttgaagatttatgagcgggtaactggagatggaaattttcagaaaaattgtaaatggatgcgatgacttcgatgtgacgttactagtcttaccattgtaaaaaccactatcggtgccaaaagataagcgcaatcaactaagaaatttaccacgctctttgtattgtatttatctccaatttaatctttcttttggtgtgaaaatttagcgaaaatgtcattggtgaattcgttaacacactacgaaattttaagaattccatcggatgcaacacaagatgaaatcaaaaaggcatataggaatcggttactaaatacgcaccccgataaacttt

SEQ ID NO: 15205 - DNA, 488 bp, Saccharomyces cerevisiae
aaatgtagctgaaagcagaagatacgtatatattgaaacagtttttttcttcctgaaatatatcaagaagttgctgcatgtctatatataaaatactaaagcaatttctttttaaattgtaatttaattcttccttattttcttcaattccctgaaaattaggacaagaattcttttatgtaatcaattccgccgacacaatgagaaactgttgattgatcatcacctatcaacttatttattttaatggcaagatcgacagttttttccgttgaatcgtgttctaatattaatccggttcctgacttgttccagtttattacattttgaagaatttcttgttcagttatgacagaatcattgagaaggaggctccaatcaaaagtatcgtgatcccataagacggcttgtaagccaaattgccttgttattgctcttactctattatctattccgccatatggaggtctgaaccatttgggggtatg

SEQ ID NO: 15206 - DNA, 496 bp, Saccharomyces cerevisiae
tgagcgcgctaaatagttgaatattttatctttaattaaatacatttgcttataaaggttgtactatttacttgtagttgatgtaggattccaattcaatgcactttaatactcagagtacgctttatacttctgcagtaccctctctaaaatgtcacctagtatttttttctctttacacaagcgtagcgtcactaaaaaaaggtatttcccatgggttaattcggtatcacactatacgttaggcgtaccaaatttcgagattcatgaaattggcttattcgtagcctttaagtactaccgttgtttctctcaaagataagagcaaatagtaccgtatattcagcctttataaattgagtatgttcaagatacctggttttggaaaagctgctgcaaatcatactccaccagatatgacaaacatggatacccgtacacgccatttaaaggtgtcaaactgtccaaataactcctatgcactcgcaaacgtagc

SEQ ID NO: 15207 - DNA, 444 bp, Saccharomyces cerevisiae
agcgtgagaatgagtatgatggaaatagtggaactatttaaaaagcacccaataaagaaagatagttactgtaaagaggtatattatcattattcagagggttcaagtaccatcatcaagatttaacacaagcacagtgaatagcaacaattaaagaaaaaactaatcaaaatcacggtagaaataggagaaaaaaagtaaaacagaaactaagtcactgtttctttatatgacatattctattatataaatatgtaaagaacgctgaacagtaaaaattttatgaaattccggcagagaagaaaaggaaaaaataagtatacaccacaccgttactggatagattgaagttcaaatcaaaaaagtttacaagtgaaataacaaacagtaaatattacacattcatgtacataaaattaattatcggtgtcaattgatttctgc

SEQ ID NO: 15208 - DNA, 494 bp, Saccharomyces cerevisiae
attttcttacatacgtatacacacgcgtacgtaagccgcgaagtgtgtatttactactctgtattattgtaataaactcttctccttctttgtcttttcttctcccaaaagcgcacttgccttgatcagcatattgtatacttcgatgttttcaaatggaggtacgacttcattgttgaacatcggacccattccaatgaatatagatgccatatcactacagttgttaaagttgtatccatgtgtgcccataatgccgataggcacatcacccatttcttttacaatggcgtagtattcatctgcgagaatccagatatcgccgaccctatcgtcatatctgtgctttctgttatcgtattggaaatatttccagctcgggtcgaaatcttctttcaggatcacgtgaaacttcctcgatatttcatctccatatgctttctctaactgagcttcaatcaagtcacaaatccattgcttgtctcgagggtttt

SEQ ID NO: 15209 - DNA, 493 bp, Saccharomyces cerevisiae
gctacatagctttcttttcatcttttttttttatttggctattctccgcttatgtttgattcgacccttctttataatttatttcttatgtatatgacccaatgttccatgtccatacctgtataagattctgagtgacaatagttcttgttatccgcaccattaataactaactaactatctttaaagtaaaactgggatcgctataactgcttagttctgttacccgctcgtgatacctgacgaccattaatcatgaagaagtgttaagatgatcgaccagcagagataaaagaatgagaaaagtagccttcaagaggattaggaaggaatagttacggttaatttgcgcctatatatttcagggatgagtgccaatagcccgacaggaaacgatccccatgtatttggtattcctgtgaacgcaacaccatccaatatgggttcgccaggcagtccagttaatgtaccacctcctatgaacccagcggta

SEQ ID NO: 15210 - DNA, 481 bp, Saccharomyces cerevisiae
aggggtatttttaagcctctttatcatatactcttttgttcgtaatagcaaataactcggtcttattaacgagaaaaagttaaagcatcttctgaatttttattatatacaagttatgtagtaaggcgccacttagcacctagaaaatatgattagcgttccgtaagctggagaccattttcaacgcatcgtgtggtgcatctttattcataacgaaaagtccttgcaactgggcggtacttacggtgatatccaattctttaacactatttacaaactttttgcatatatcagtctcacctgggtaaaatttcataaacattttttctacctggtatggagttgcgttaccaacgaagactttgtagtcaatacgacctggtctcattatagccgcgtctagcttttcaggatgattggtagtcatgaatgtaatagtttcttcagaagatgtgacgccatccagggcattcagtaaacc

SEQ ID NO: 15211 - DNA, 403 bp, Saccharomyces cerevisiae
tcgtcatcattttattcacacctccggataatccattcttccccggaaaaacacatgtacaatatatattatatatatatatatatgtatatcaaatcatacaacttacataaaaacaacaaacctgaatatttttccttttcaaaaagtaattctacccctagattttgcattgctcctctataactcattattggttaaggtgtagatgtcaccaagtttatcaatgtaaaatttaggtcttggataatcgtgcgaaatcttcaaggctctctcttcggtttcaataccactcaaaacgagtagtgtgccacctaacccaccttcaacaccgaatttcatatcggtgtttaatctgtcaccaaccatacagcactttgatctatccaggttgaatgccgat

SEQ ID NO: 15212 - DNA, 426 bp, Saccharomyces cerevisiae
gactgggaatgagtgatttttttcatataaaagatatatgtaatgctataaatatttacatacttttcatgacgtattatggtagaaaggaaaatcatcaatccaagagatgcacaggaggaagacaaaatctgggcgtgatctcatctttacaccttctaaaaaaaagttcgtttgttaccgttaaaataaatcatttgtatttagggttttttactttgaccttagatggaaataatgatatgccatgttgaacgggaaaaaaagtgtatagacaacggttttcagttatttattcaaatgaatcaaacaccgtagacgcggtgataaaacaaaacgtatgcattagagttaattgcatcggctttgtttttgacaggtttatatttggtatcatcaaaatatagccatcccttctttaatccc

SEQ ID NO: 15213 - DNA, 425 bp, Saccharomyces cerevisiae
aaaaaccccttcggtacgtaatataaaaaattttataggtaatatacatatataaaaatacttcaatcatttttacaatcttgtatactttatacaacatgtgaaatcttctgcttctggacatcaatattcaaatacaggccaatcttaggtaaaacatttggagaaaagaaggataaggcaggacgagggaagataaatagtttcgttaattataaatacatgcagataaataaaggaatatcaaatattatgaatagaaaaagaagatggtgagacaaaaaagtagtaataaataggtccaaatcttctttatttcccctttcttttcttatccttttgttttctccatattgtataagaatatattcttaggaaaatcaacagggaatacagtatagtgattttcgttcctttttgagcgt

SEQ ID NO: 15214 - DNA, 444 bp, Saccharomyces cerevisiae
tgttccattcgtaaactttgtatggatataatattaagacaaccgtaagaaccgtggtcgtttgtttaactacggcggcttctggtattactgaatttctctttttttcattttaaatcaatttattacaggtaaatcaatcaaacaaatatatatatatatagtatacagaacaaacggtaatttctttttttttttttcgacgttagacgtgcttcggcagatatagtaagttggaagaaatgaagaattgtgaaagataaaggatggtttttttttttatttttttctagctagattatcttctacctcctctgaaaccaccacgagatccgccacgagatcctcctctaaatgatccgccacgagatccacctctgaaagaactgccaccacggcctcctctgaaagaactaccaccacggcctcctctgaaacctcctc

SEQ ID NO: 15215 - DNA, 434 bp, Saccharomyces cerevisiae
cattatacattttattaacgcccccccttttttttttttttttgttgatgcagaagcctcgcaacttaaagcttttcagttgtttcttcttggtcatattttttatacatatatacatacatatatgcatgtgctgtgtactacatgctgcctttcttcaatttttatgtatagacaaggaggccagaaagatattataaacaatgttttttatgtgaacttcgaagtactttgaaaatcaaccctcccatcttgcgagacggtcgcaataaacagtgagggtctgttggcaagctcaatgatctttgaatttacatcgttagccacttgtttctctaaattgacaccgttatcattcacgttgctcttcttaacgtggcccttggacgttagtttagttagaatattatctttggatgttgtcatttcatgcg

SEQ ID NO: 15216 - DNA, 464 bp, Saccharomyces cerevisiae
ataagtttactggcttacaattcgatatttttgcaacagcagtgctaaccttttattatatttatataaactctaagcttttatatctacattatactaataaaaaaaacttgttcccgtagtaagttttccggctaagaaaggaaaggctattgccgctttcttttaattcttcatcaatgcctttagattgtctattgttttttcaacagtagtttctaaatagttcttctttatctttaatgtttttctttgatccagaagaacagtttcggcatgtgataaatcattaacgtatttggatttatcctgtaagataaacgatttaccgcaagatctccatactttgtccgttggataagactctagttctttctttgtcaattcagcaagcttttcttgtctgtccaaatatgctagctgctgattgaccatatccaattgtgtcctggcgtttcttaagc

SEQ ID NO: 15217 - DNA, 491 bp, Saccharomyces cerevisiae
gccaagaaataaactttttaagattataatacgttaaaaatttacatattattttgtctgattttatataacatgttttattatcttaattgaaggaaaatttatctcaatatccagtaccgttttctttttttatttctttttttttttcttttaattttctttttcctccttatgtgccacaaaatggaagcgtcacaaattaataacaaaagataaatgatgtataaaacaatggtgttgaccttctactgagtagcaacacatagagaagtataaggcctcacataagcatacaaacaagcccgcaatgacagaacaagttaacaatgacactaccagtgacactaccactaccattaccacagtttacatttcgaacctgccattcacggcgagtgagcgagacctacatgccttcctaaacaactatggcgccagttcagtgttgattccaacgcagaccgtccgcagattcagcaaaaggcaca

SEQ ID NO: 15218 - DNA, 459 bp, Saccharomyces cerevisiae
gtagagaagagatacatagtttcgcagtgtgttactgtgtgggactgtataggtgaagccctatatactgtgtaaaaggcgatgaaactttattatgttatatatcactgcttcatataaaaataagaaacctacagcgtaatgattatacatatgacgaagactgttaactgcaataaagatagtaacgaccttataagtgcacactttttccccagggccaacgcaatggcgaatattgtcaaataagctaacaagaagaataacacagtgctaaaaagcagtgaatgtttcatcttctccatcgcggcttccttatcttaccattttttctttacttaccttccactttgccgcccagccctgactgtttttaagtgcagctaaaaaaatctatctaatcactcgccacatatatcctacataatacgtcatactcaatgcaaaggtagcttgagg

SEQ ID NO: 15219 - DNA, 428 bp, Saccharomyces cerevisiae
gaagacgcttaattgattacaaataattagctaagaaattacgtaccttctcattgttctatatatgttttattttctctaaaatgtaccaaatacaataatagtttcaaaggagcagagaaagaaactaaggtgaaggagactgttcgtagaataaatgaatattgattaaaattttctgaaaaaaagagtaatgaagtcgtagtcatcgctaatgtaccgtaagtgagttctgaaaggaggcgggttcttgtttcaacgtagcttgtctagtcctttatggcatcgtgtaaaattggtatatattcagaacacccaggagtgaattgatttgctgctatagggggaaataagatgtaacgatattttttgtactgaatttctttgatgatactgccaggattgagagtttggttgccacatgtacg

SEQ ID NO: 15220 - DNA, 403 bp, Saccharomyces cerevisiae
cttataatacaaatataccacatacatagatataccctacgtatgttttatgctgtatttctattggagaaagaaatgaataaacgcaaagtagtcaatactagggagattagcacactacaatctaaggtcacgatctcagaaacaaaaaggtttctcatctgtttatgcttccacattcacggtggctcgcttgaagatcagtctgcgtaggagtcgatgtacatacgagaaatatgatgatagagtaagcgatactaccaagatatacgcccgctgctactctcaattctatctcttagtattcgcaatctgttatcgtctgatctcctgtaaaaagcaatccttttcatcctcacacaagcaagcactaaaagggcaactgttttgaagcttaagcggc

SEQ ID NO: 15221 - DNA, 427 bp, Saccharomyces cerevisiae
atgtttttttaatgatatatgtaacgtacattctttcctctaccactgccaattcggtattatttaattgtgtttagcgctatttactaattaactagaaactcaatttttaaaggcaaagctcgctgacctttcactgatttcgtggatgttatactatcagttactcttctgcaaaaaaaaattgagtcatatcgtagctttgggattatttttctctctctccacggctaattaggtgatcatgaaaaaatgaaaaattcatgagaaaagagtcagacatcgaaacatacataagttgatattcctttgatatcgacgactactcaatcaggttttaaaagaaaagaggcagctattgaagtagcagtatccagtttaggttttttaattatttacaagtaaagaaaaagagaatgccggtcgt

SEQ ID NO: 15222 - DNA, 494 bp, Saccharomyces cerevisiae
cttctatacacatatagccggtattataaaatatataaatctatcttctttcaaaagtttctctgtgcagtctgcgttatattttatcttcggtagaaaacaaggtaaatttcccttatttttcaacatcataaaaatgaaaaacagatatatcttaagtaagatacttaagcagacaagttgaattggagaaatacaaaagctgtaaggttatcaaaaaggaaggcatacagtataatgggggcacaattatcactagtggtccaagcatcaccttccatagccattttttcatatatcgatgtcttagaggaagtacactacgtttcacagttaaactcatcaagattcttaaaaacatgcaaggcactggaccctaacggcgaaattgttatcaaagtgtttattaaaccaaaagaccaatatagcttacgaccttttctccaacgtataagggctcaatcgtttaagttgggacaactaccgcacgtttt

SEQ ID NO: 15223 - DNA, 446 bp, Saccharomyces cerevisiae
cggtagaaaagctcgaccttaaataaggtgaagatgtggttctctgttctttcaacatctcgatatttaacttttcgtttggcattatagtgttatacataacaatatctagatttcagtagaagacttttgcgtaagttataacgaactaaacaagcaagaggtaaaatacgatatagtaagaagctcaagtgctaaaactttttttctctacgaaaggaggaatagcatatggttttcttcccttttacagtgcttcggaaaagcacagcgttgtccaagggaacaatttttcttcaagttaatgcataagaaatatctttttttatgtttagctaagtaaaagcagcttggagtaaaaaaaaaaatgagtaaatttctcgatggattagtttctcacaggtaacataacaaaaaccaagaaaagcccgcttctgaaaactaca

SEQ ID NO: 15224 - DNA, 401 bp, Saccharomyces cerevisiae
gcgaagaacatatttatgcttcaaactttttgtcatttgtcttccatccttcccttattctcaatatatatgtaatacgtcgtatttgatatatatatatatatatatataatataatttaacggttgttatctgctacatctgtaaaataaaaataaaaatgcttgaagcggctgtacttaaaataaactcatctaaggttttacatggtattactaccggactgcaattacactctttttcgttattggattatttatacaatgcggcccataagcacgtgtgggaaaaaagtatgtaaataaaacaaggttttttgttccatttatcatataaaaaattttggcttaggtccaaagtcgtcttcctggataatagcacctgcattgcgtgtcatttct

SEQ ID NO: 15225 - DNA, 476 bp, Saccharomyces cerevisiae
accaaaaaaaaaaaaagaaacacttgatttcctttatctatttttatacttaattattttttttagatgcactatacaaattcgcgttaatttttgcctttttacaacgcctccgtaggggtctttttgccgcctggcacaaggatggcaatattgttgccgcttaaaagcattctgccatggtgctgcataactttctcatttctgctctcgtcctcaggatcgataagccactcgacagcgtcttccagtataacgttgacgaagtcgtcgaaaccaactaacgtgccctcgaactcgcggttcgactgcagcacaatcaacactttctggttaattgttttatctatgacttccaaaggcaaaatctccggtagactcattttgcgcgcttctgtgtatgcttgtgagtgcacgtgtatacgctatgcttgttgtgagaccatctatccgccaaggaagcctttttcgctttc

SEQ ID NO: 15226 - DNA, 438 bp, Saccharomyces cerevisiae
taatttgcgaacacttttattaattcatgatcacgctctaatttgtgcatttgaaatgtactctaattctaattttatatttttaatgatatcttgaaaagtaaatacgtttttaatatatacaaaataatacagtttaattttcaagtttttgatcatttgttctcagaaagttgagtgggacggagacaaagaaactttaaagagaaatgcaaagtgggaagaagtcagttgtttaccgaccgcactgttattcacaaatattccaattttgcctgcagacccacgtctacaaattttggttagtttggtaaatggtaaggatatagtagagcctttttgaaatgggaaatatcttctttttctgtatcccgcttcaaaaagtgtctaatgagtcagttatttctttcttactcatcgcccgtcacttaaaagaag

SEQ ID NO: 15227 - DNA, 483 bp, Saccharomyces cerevisiae
agagagctttaacatgaatataaatatatatatatgtatagagaaagtgtgcatttacgtacaagattcaagttattcattcactaagatgttcaattaatattttggaatcgtccatttcgagcgaatagtcagctgcatctcccttttctgacagggtcaatagctctttagccaataatccatgatagtttcttttaaagcggtaggcgtcatgcgagttttcgaaagatataaatcgtagatttcttttcatttcatcatcccagtatatcttgaagctagaccttatgttgtaaaaccaaaaataattcaatatatcgtgcgaccgtaatttagtgggtatattccagactaatacggacttattttctatttcttccaccgaatcaaggatactccgtaactgattggtagtgaactctccactaacatcgactttttcgtttagtccctcaaaatattgctcagatgatcggaatg

SEQ ID NO: 15228 - DNA, 419 bp, Saccharomyces cerevisiae
tatcactattaaggtctattagccatatgtacattgtctatagatgtgtaactgcgctgtgatcttgttttgaccaatcaggagcgacgcgctttttatcgggtcaccccggcggggggcctgacaatttactttcatagagcagtaataaaagggaagagatgtaaaagcttggaaaaatagcagtaaaggttgttgttggacaatttatcagaatattagtaactgtaattaaacgttccagaaagaacaaaatgccacagtcttttacgtctattgcgagaattggtgactatattttgaagtcacccgtcctctccaagttatgtgttccagttgccaatcagttcattaacctcgcaggttacaagaagttagggctcaaatttgacgacttaattgcagaggaaaatcccatc

SEQ ID NO: 15229 - DNA, 450 bp, Saccharomyces cerevisiae
gtcgatctgtaataagtaggttttcttttatttcaatatcaaaatatgccaaatgtgcaataaaaccataactacgtatgtgatatttctgagttttgtccccaaaccgtaaagagcgattatctcgtgcaaaatgcatcaaaatcaaataactaaaatgaaagggtatcattattattcctaaaagttaagaatgcctccagaaagaacgggtaccaacgcaaacgaacacacgttttgttcactcctaatgttgaagtctatatttgcgaagcgatttgcttccacagggtcatatcctggttctacaagaattactttgccaagaaggcctgcaaaaaaaattcaactggggaagtcacgaccggctatttatcaccaattcaatgtcaaaatggagttgagtgatggaagtgtagttatccggagatcccaatatccaaagggtga

SEQ ID NO: 15230 - DNA, 427 bp, Saccharomyces cerevisiae
ctttatttccaggttgctacgtgattatgccatttgtgatccgtttggtgattcttttttatccttcttatataaataaatatactcttactacgttattgaatgtgtactcttactgaactgtgttatacaaaacgtaaatgcaattttcaagtaccaagtctagccctttttcctcgcttgtcgccactatgttaataacctcatatatgctaatacaagtgcaaatgtacctgtacagacacctatcagccattgcatgacttgagtcttgacagaatcaatctgcatcttcatattggtcacttcttgctcaattttggtgtcgatttcttttatttgcagatcgtgatgactactttcttccctaattctgcctttttctaaggacagatcaagtttgaaaccggcgtttgttttggtaatt

SEQ ID NO: 15231 - DNA, 441 bp, Saccharomyces cerevisiae
tttgaatttggttaagaaaagaaacttaccaagatggacttttttaataaacatacataatcactacatataggtgcgtaataataagtttttattttttttttcttaattcagcgagctttctacatttcaattttcttgaatttaccagctctgataaatcaaagttcaatgtccgaaagaattccgagaattttattcctaggttatctcatcggtactttttttttataggcatcagcatttagtgtgaaaacattatttcttaactgtgccttacggttaaaaagaaaggacgcaatggatatagttaaaatataagatatattatatcattatctgtccgaatggcgaaccgtcttctcatatacggccttattttgtgggtaagtataatcggatcttttgcattagataggaacaaaactgctcaaaatgcga

SEQ ID NO: 15232 - DNA, 400 bp, Saccharomyces cerevisiae
atggtctattttgtagagcgaaattaagtaaagaattgagtattcattatgtagatctaatctttaacgcagtgaaaaaagtcctcgtttttggtgactttttttgtacaattacttttttgaaatataacgaaagttagcagattgactactaacttgcgatctggaaaattaagagaattcaaactttttttgttgcatgggtcaataatcatcattagagcttgccttgatcaatttccttcacatttttggaataactaacattataaatcaagcctagtatagcgcgccaaagaagatggctaaagatttattgcccaagcaagcggccaacgagccatcgttaaaggactgtacctgtaaaagatgtcttaaattgggtgcttcaaaagaaaaa

SEQ ID NO: 15233 - DNA, 456 bp, Saccharomyces cerevisiae
gaagacgcttaaattttctttaattaatttatcttaatatacatactcagttaataaacaggtagcaaaaacttcgataatacgtatgtatgcacatatacctacataactaaaacccatttttctaatattctcatctcaattgtttatataaagggtactcgtgcagacggacatcgaggtcgaattgatgccattaggagtctgccaaactatttaaaatagaccttcaatttcaccgtcgtcgtcgacttctactgccatgtaaccagcatatgtcgatagacccggtatggtttgaatttctgcagccaaagcgtataaataacctgcacctattgaagctctcacatccctgatggggaacgtaaaacctctaggaacaccctttaatgatggatcatgggataatgaatattgtgtcttagcaatacagatgggaagattaccgaagcc

SEQ ID NO: 15234 - DNA, 466 bp, Saccharomyces cerevisiae
tctatgtgaatgcaccgcttatatatcataagtacactaaatcaagttcttccggaagatgcgtcatgtagaatgcataatagagtaatatacactaaataatgcgctagtcgtgtatcgtgatcatgttctctaatgttctttttcctgcctgccctttcctacatggaaagttagagaaatgagatctacacgataatgtagtaacaaatggacccttaaacatctcaattcatcttcttgagagcactttccgcgctgtattgatttttagaacgtgaaaaggataaactgaaaacttgaagtcctaaccatgttgtctcaaacctccataccggaagtgaaagaagacgtgataggctatgcgctacaccagaggagagccagagtgggacaattccaagacttgggtccgcctgatttaattactttgatcaaatcgttaccttcatcctcgagcacaaca

SEQ ID NO: 15235 - DNA, 410 bp, Saccharomyces cerevisiae
ttttagtgtacgtgcccttatttatgaaaaaaagtcaagtgcatgaatgaaatatttactgttgaagaatttattatatatataggtatacaggatctatcttttcgataacgtaacttagtatcacatgtattagtattaatactgtgataggattgttagctgttgtttttatatttgcaatttatttatgatcttttttgatgatcaaaccgttgagtttttgaacattaaaaaatagtgagaaagaagaactgaaatgggaattgaattgatcaatatctgtagtggtcggccttgaatggaccttcttctggaatacccaagtattcagattggactttactcaatttagtcaatctaacacccaagttgcccaagtggaacttagcgacagcttcatccaagat

SEQ ID NO: 15236 - DNA, 454 bp, Saccharomyces cerevisiae
caaccagattttgtttggttatatttcgactagaatatatgtatgcatatgctaaaattgtacataggcatttacgaatgaaaatagtgtagaggtatgaacaagactaaattctaaaagtttagaggagtgtgatcaatttgtcgatagctgtttttttggcttgtggagaaggagatttttcgccacataaatattggctaaataagaattttccgacgagttgattattaactactcccatgacctcaaattcgttgtttttactgtcatgatatgaaaattgtaaagcgccgttggctaataattcgatgatcaaatcgtcatttttcctgacggatcccttacgtgaaaaggcatcatttaactcacttaggcccttcgccagtgtgtctttattattggccacatcgggatgtttagaaatagttttgaccaggccctccttaagatg

SEQ ID NO: 15237 - DNA, 449 bp, Saccharomyces cerevisiae
gcatagacagatacataattgactacataattatctctgttattagtatatcacagagcttccgggtaaatgtccgcaattgtaaatttttttgtccgcttcagggtctcccctgatattttttttttttcaaaaattccttttttttaaatcaaattttgggctcaattatggacaaatgaagcacatgcaaagagttaacgcgtgcgactgaatagaacaactctttcagcatcgcaaacccttcaaattgtgaataaataggcatttcaagtaactgtgtcagcagcacattgcataggaattctgattttttgttttagtgactgccctcctaatttttttttttttagtttacggctatagctaaatttggagctttctttcattaattttcaccgagctattaataaccctacaaaaagagcagagaggtacagcctgatccg

SEQ ID NO: 15238 - DNA, 468 bp, Saccharomyces cerevisiae
tgaaatagaaacgcttgtgtacttatatatgttatcataatttctatttgtttatttcttaatccagtaaagcataaaaacttttataggctagttctagatcaaacagaagttctctaatttgtgtttcagttaaagtgtcaccaattgagagtttatttattctgacaatccagtcaatgagttttgatctattctcaaaatcatccctggtgacgcgatttatgctgattaacagttcagccaataagggatgtaattgatcttttgcattatagtttagtttcaaagcatccattacagtgatgaaattaccagtggcctcagcgacgtatttagcattaaactttttgtcgctagaagaactttgtttattatcaccagagggagccgatgtggtagtggatatcgcatgttctgctgtaattggtatgcccctctccagtcttgttattgcgttcgaagcag

SEQ ID NO: 15239 - DNA, 465 bp, Saccharomyces cerevisiae
gaaaattaaacctgaagtagaaaaaaatttttctcctgatctttcttcattacttaatttttctttggttgaggtgatgtttttttctgtacttagtattcactacgttaaaaaaacacatggtcttattttccaaaatgcctattccctatatatctttgcctatatgtatatagtattaatagcttagattgtttctgctttctaaaaaaataaaaattgaatcacatactacaccagtctgaatacatctaccaacgtacacattcatatatttctacataataaattgcagatttacgtcaatagggtgtgacgatgataattgtggtttttgagaatacttaccagccaattctttcctcatgttctgtaaaagagataaatatgattgctgtggttgtaaagtcataaccttgatgaaggcgtgggacattgcacctgtattttgcccatcttcgacag

SEQ ID NO: 15240 - DNA, 486 bp, Saccharomyces cerevisiae
tgagttgtcaagtggcatcataatgcattggggcggctttcagatatgcttctggtatatttgtccgtgagaaattaaggcttcttttcttatatatgtatatattagttaaaagaatatcatcacttttttctttataaaaccttgcagggatgactatatttcaaattgctaaagtttaccaaaagcatcatatatcttttctgaaagagatttagtaattttcttcgcaccaggtgcatctcccagtacattaaacatcaacaatttagcctcttcttccgaggagcacgttttatatgccattagtattttattcagggtaggaaatatttcttggatggctactgctttttctaaagatatacctttaacaagcattaaaacatgtatagttagctcaccaaccgtctttagatcgccttttcccattagttcttgaaagcattcaagattatgacagcattcaataccgccttttcgttc

SEQ ID NO: 15241 - DNA, 417 bp, Saccharomyces cerevisiae
gcatcataatcagggagtgtattttttttcgttgtcgttatcctctttgtattttacgctgttgaattctcttaggattcgattcacattcatctttttttagctactaataggataaattataggaatttataacaaattgaaatatggcaggcagcaaaattaaaattgtcttagttttttagtgtatagaagtgaatagctatataaagtatgtgtaaagttggtaacggaacgaaaaatagaaaaggatattacatgggaaaacatgttgtttacggagaaatgaaaagtatattgtattttgtacgagctaaaagtacagtgggaacaaagtcgactttgttacatctacactgttgttatcagtcgggcttagtacattggttggccgggttttaactgcaaccaatgcca

SEQ ID NO: 15242 - DNA, 495 bp, Saccharomyces cerevisiae
ttttgttttcaccataacaaagagatggaaagttatactagataaagatttttaaaaaatataaaagaaaataaaacgaaatttatattttacacagtgcatcttgtccctctctttctcgctaaaacttagtttcttcttcgcccatctcatgattcttcttatggtttgtgaggctgcctagtccaccgaatacccctttcttgatcttgccaatggcaccaacaccgccgcctatcacggtcgtaccagctttcaaaccagtacctagtcccttggatgctatatctccgaccttcttttctcttttactcacgctaatggtgtatcttggcttaaagctgaaagctaaatgcaacataccaccgtcttgaccagcgttctctaatccttctaccggtacgtctaattcggtagtaccctcgactttgaccttattcaatgggatttctgctgtaccaatggtatcatccgcagatgtggaatcccagtcca

SEQ ID NO: 15243 - DNA, 455 bp, Saccharomyces cerevisiae
atacactaattttatgaaagctaacggaaaagagattagtgcttttggcttattacaaagtttgcggcaatattttccttatcagcatcataagctgtcagtatttcatgtattattagtactaattaactatatgtatatatatatatatatatgcttgcaagtgttgaatttcctttctcaaaagaatgatattatctttaaattttgatgtgtttgaagataggctttccaaaaatccattcaatatggtgaatcgtacctcatactcgattaaaggatcacatttcgtaattggacaaccgctgactgtcatttcaatgatgcgttgtaagaacgaatgaaattgcatattttgcgtaacattaattgatagatccttaaaagcagatttataacattccgaaatgttctttacaacatgatcaatttgcatgagaacggtgtttgttgaa

SEQ ID NO: 15244 - DNA, 421 bp, Saccharomyces cerevisiae
attaacccttttactttctcttcgtcccccagcctcccatccgtctttctacaatcacttctccttcgcttttaatttttgaacttccattattctgcaatgcgcactacaagctggcgttaaagatgattccacttgtattctctatataaataaaaaattatattttatatgaataaccaaaaagatagttgcagccctaaattagacctgctaaataaatgtgttctaactttgttacaatttttaaaccatataacttccttcttgtaagtcctctaaaataatattaaaccctatcctgagttgggccctgcgttttacccgcaggaataggcccgatgattgattatccacatcaacttttggtgaaattcgagagaaaataaatgggaagtgaacgagcaataggcaatcaaca

SEQ ID NO: 15245 - DNA, 418 bp, Saccharomyces cerevisiae
gtcgagtggtaagtaaggtgatatttacaaatagtatattaataattatagtataatgttttattagaataacagatttctttatcaatttagcggctaaataaaaatcaagaaaaaagaaatacattcattgtgtcatcttgtcacacatttagccatgtactttatttgctgagaagtttaatcaattgagagtagttagctattgtagtaaaaatgtgcaaatgaagtcttatcaacacgtagcgtatatagtgatctaaaacagttagaaatataataagcgaacttctaaaccattttagagcacatagccatggagaataggtacttgttttgacccgctcgacgaagtggtacgtagtgattgcgtggattagtttatcataagactttcaatgaacgtaccaaaggcgag

SEQ ID NO: 15246 - DNA, 483 bp, Saccharomyces cerevisiae
ttttaagctttgaataggaattttttttttctatataataaatatgtaatttcataatgacagtgtagaaattatggctaatctaatccatgcaaaggtattatttggttattgtttttgtaatgaaatagtataaaacagtgatattcttacggattaatagtttttacgcccgtctgaattttctaagctgccgaaaataatggcaagtaacaaaaagttattgtatgaggatgcgttttacgtggcaaaagttttgatgccaaatagacaaaagtagctcaattcaacatgacctcatcatctggtgttgataatgagatttccttagacagcccgatgccaattttcaatgagagttctactttaaagccaattagggttgcgggtgtagtaacaacagggacagatcatatcgaccctagcgtactacaggcatacttagatgatactattatgaaatccattactttggggcagcta

SEQ ID NO: 15247 - DNA, 449 bp, Saccharomyces cerevisiae
ctataagtaaccggggaagtatagaatcaccatagatgtaagcttacagacaatgtgtatatatgatgtatatgaacgtatacaaatatatatatatatacgtgctcttgttgtagctcgtatatcaaattcctcctccgacgcttatcttaatcgtactccgcggaagtttgttatcgcctcttgaattctttcttttcgttcatttatgattagtcatctatagacaatattcattatttaagcacctagaatactaaactaaatgtctaaatatgacacaaggaagataagataaaaaaaaccaagcgcttagaatatgactttaatggtacctttcaaacaagttgatgtattcactgagaagccctttatgggaaatccagtagcagtaataaacttcttggaaattgatgaaaatgaagtcagtcaagaagaattgcaggcaa

SEQ ID NO: 15248 - DNA, 480 bp, Saccharomyces cerevisiae
tagaagttcactcgcaatgctatatatatagggagcttccatatgtagtgtaggatatatgtatatatacatatatacatatatgggcgtatatttactttgttcttattttctgtctaattttataattttactgacagtagctaagccctctgtattgctgttctgtgttattgcactagtgtcataacgcagatggtttttagcagagtcaaattgggcagaaagcataatttccatcttccctggcaaagacagattttctcttttgatcacgttagctaaataattcaagatttcgttcggtactccagcttcgcccttgttagcaggcttgtatttcaacagaattgcttgtatttgggctggattcaaggcataccagaaatcgaatagtaacttgaactcgttcaagttgcttatcttcaactgtaatatcttgacagcctgaattatttgaatcaaattgggacgaacgtc

SEQ ID NO: 15249 - DNA, 491 bp, Saccharomyces cerevisiae
ttcagctagaaacagaggtataaagatgtactaacaatgattattaacacaaatcggtacgtatctttttttatattagttataaagatgtacttactacctttttatttcacgagtaatgttctccatgttttcttaacgaggaaacattgtataacgggtaaatttcttctttcttggtcaccaagttagaatccccttgtactgattgtatgatggcactgtcaaattcgtttgatttttcattattcacgacaaaactattctcatttaagttatattcaatgaatttggcaaaatttttttgcacaccagatgattccttattatctagggtgacttggaattcatcattatgggcggataatgagataacattatatggaaaagttataatttgctttagtgcaagatcccctttttgtttttcggacatttccagaattattatgcattttgtagcttcgacgaaaaacgcaacaaacggtagg

SEQ ID NO: 15250 - DNA, 432 bp, Saccharomyces cerevisiae
tagaaatgcgtaatatgcaagtagatatatttacatacacagtttctctcaaaggtagtaattatcttatgtgttaacgtacggttgctaagaaataagcatggtaactttcttaggtaattctttggtattaagatatattctgaattacggtttggactactttattgttcagagataagaaacatgttgagcagcactttatggtgttgctatattcccgttcaaatacaacagcaacaaaaaatgcttatccctcatcaaattgaacagaaaaaaaaaaaccatattattttattcaagcttatcgcatgatagactgtatatggagcagtcaaaattgactgctaactgagttttcattttggaaatcttatcattttgcgttcaccgattctaacttattttcatcacgaatacgagaagggcaaa

SEQ ID NO: 15251 - DNA, 459 bp, Saccharomyces cerevisiae
tgaaatagtggtgagatacactgacattattgttatcagagaagaatatataaaactaaaatacttaatatcaaaataaggaattttttatcaaagtagaatttctgtaagctacattctcttggtgtagaagatttctcgactgatgtaaaggacaagtcgacttgtcctgcctcatacatacttgacgatgaagagcaagatactgagcacgtgaatcgaggaacaggtaaggatacctcgagaaatgaaaaaaaaaagttgatcagccgtacttgaaaattaaatttggcggtgagaaagacaatatcgtaatgaaaatgattctgacgaccctttgatagtggcaatgatcaaaaagaaaaaaaaaagataagacggtagtgtgaagatgacatatagcgctactctatactcgtccaacttcgaaaataatatgtggtcgttggtacgttcaga

SEQ ID NO: 15252 - DNA, 434 bp, Saccharomyces cerevisiae
ttcggcatatagaaacactttgtatctgaaattatcatctttatgaaatctcaacagttgtaaaatttcccgaatatttatacatatatatgtgtatgtaattacaagtatttaggacaataaggagagatttaagtctactacataatttttaactcctacaaatggcaggttacgttgagtaagaatataacattttattttccatattcaacatcatatgcattttatcatctcatcctcttagtcactaatttttctaacgctcataacaaaaggtgcgttacgccgtctagagcttttcttgaacgttaaaactttaccaagcagttgacgggtaatcattctcataatccaagtaattttaaagatatcaacaaaatgtactataatgccaacacattctttacttatattggccggaagataaatcc

SEQ ID NO: 15253 - DNA, 469 bp, Saccharomyces cerevisiae
tgatatgtaacagcttatctacagtgcatatagacgcgtatatatttaaaagagggtattcgcttcttcttctttagattgcattctttgatggttaggaaaaagaagcgggaacgtgattaaactttttattctcttttatttattatatattatagtgcattatcattatctatctaaatttgcctttacacggtactgctttccgattttactgggtaaagaagtttttcatgagtacctcttaaatcaacctcacttaaacctacaataccaccgaagctttgaaacctcttaaaataatgatctcttttttcacgcgcggtttccaccagagctggccaataaacatcatgattgtacttgaatttcagatcaccaccatacaacgaatctagttcgttcttagggacatatttaacaaatggttcatcaaaaactagcttttcacgggtcagtgggtcaataa

SEQ ID NO: 15254 - DNA, 408 bp, Saccharomyces cerevisiae
atcagcagaacaacttttatctctcgcccatgaagttagatattattatttagtcagctataatatactatataggatggtcgtccaaggcgatcttgcgatctctcatctttaagaaaagtaaggtcgttgatattattgacattaaaggttatggatagaggcaggtggtgtttcctcgtgtccgtatcaagcagaataatgaatctgcaagaactattagcgaaagtaccgctgttgttatcgtatccgaccattattctatccagtaatctgatcgtaccttcccataatgatctcatatcacgagcagcctctacatcagcagcagagtatgctgacgaaaagctaatatttttcagtacagatcatgccatcagactgatttttctgccaaccttcgtagct

SEQ ID NO: 15255 - DNA, 491 bp, Saccharomyces cerevisiae
atgcagtaatcctttgtacgtactctgtctatatttccctaacttttaagcaactgtataatttttcatatacgggattttcaggaaaaaaaacaatagaaatctataaaacatgtttccttatttttacagacgagagttttattcttgtgaaaacgtcgttatcttctcctccaaaccaattcaaggaataaagatatcacgtatacgggagagatacatagaaattatgttatcccgtgtttcagttttcaaacctgccagcagaggcttttccgtcttatcatctttaaagataacagaacatacatcagcaaaacacaccgaaaaacctgagcatgctcccaagtgtcagaatttatcagatgctcaggctgcatttttggaccgtgttattcgtgtagatcaagctggcgaattaggtgcagactacatctacgctggccagtacttcgtgttggctcataggtaccctcacttgaaacctgtgc

SEQ ID NO: 15256 - DNA, 488 bp, Saccharomyces cerevisiae
aaataggaagtacatagtatagacaaattttataaatattaacttttatttgttgcgatcttcactaatctacgcagattttgccttcggtatattagccttcttcttgttgagtgcttcccaagtgattccaccaaatactataaacatccccacccattgctggaaacgtacactcttaccgaagacaataatactcaaaatcatcgagaccattttcctggtgactgttatcatgatcaaaactaaagagccaaattgttctagagtatagaaaataaagcattgtcccatagcgccacagaacgaataaagcattaaatagccccacacttgtgggtccatcgtcaatacagaaacggcattatcccattgtttgcagtcgatcacaataaaatacaaaatattccacaatatcacgaagaggttcagtgtaaacatcaagtgtgcacctgttatcaaagtttgttttcccttttctttggcct

SEQ ID NO: 15257 - DNA, 499 bp, Saccharomyces cerevisiae
tgcagaaagggaaaaggaaaaaagcgaagagataactaaaaaggattaatagtatacgtaatttagtctactgtaagtatggtcaaaaattttctttagtgagaaaaaaaaaaaaaaagagaaacgataaacgctgtacaataccagtgactgcactgctccgaaaacgtccgagatatgtatattgtccgaattttttcatactttaatagctggccagagaaaccttataattttgtggctgcaagctatcgcgctgttcctctgtgacaggcaacacagaacaactaaccgcctgtcttttatgcctgtacacttcattaaaatttaccgttttcttccattacaagcggggacactttccgtttaaacctgcaatatgttgcagggcctatccacgccaatttactgtggcagaagttactgcagtggaagaactaccttttccagcatagcctccgccaccaaaaaatgcaggtgctgcgttttctggatacgt

SEQ ID NO: 15258 - DNA, 491 bp, Saccharomyces cerevisiae
ctttcaggcgcagaaaacctgaaaataaaaaaaaaatgcaaaacgagagtaaaagttgtaattatatttatactaatatttaaattggtaatatgtaattagacttatcattcactttggtttagcagctagtcatgtaatggcactaaaagtgcttctttatctattatttatacgtgacataccattacttctatgtattacgtaaagaatgacaaacgtttagtttttttaatttcaaagaaatcgttggaaggttcaaaaaggatcaggtgagatattagagtatatgaatgtttcagtctctaagctacacaaagaactagcatagtaggactttaacccatacaatggaactcaacgacccttcaattatatcaagcagccagttttcaggtgaattgtctgacagcgatactgcagccgctactcacaaatcgcaacaagccatctcaaatttattccaaaaattagccaaaaagggcagagaa

SEQ ID NO: 15259 - DNA, 428 bp, Saccharomyces cerevisiae
tattttccaagcttttaatcctcattttcttaacaattgcgtatatacatatttttttattttctagactagaccatgaaaaatctatggtaatatacacatacggagttttaggtacaacttctcgttacatatccaattcaattatcgtaactgtaaataacatcttcttgtgaaaattcgcgttgcgcgacgtgaggcgttaggcaattttttgtggaacgtttatagtaataaaacaactaataacgttaacgttcctcgggaagaaatctacacatacaaaaaataatcactagtaaatagtgacaggtcttttgtacatcatgactgatttcgatttaatgaattttccatttcatgagcgtttggattctcctgtatcagagaatggggaaattaaagacggagagccaatcccacaaaac

SEQ ID NO: 15260 - DNA, 434 bp, Saccharomyces cerevisiae
atggcgatcacagaatgtcagtaatggcgagtgaaagaggcataagagggtacttaagctcaaaataacatatgacttttttatttaataatatttctaaatatacaatatacagcttccaaatcctaaagaagaatattagaagggaataaaagataatatatatatatatgaaaaactttaaagggaagaaaagtacacaaaaagatgggatatactttatttcgattcattgttccttttaatccttacttttcttctttttatccttcttttcctttttatctttcttttcctttttgtccttcttttccttcttttctttcttttccttcttcgattttttctctttcttttccttcttttcttcatcatcatcttctaattttctcttctttgaggattccttttccttggtttcttccacttctgca

SEQ ID NO: 15261 - DNA, 433 bp, Saccharomyces cerevisiae
agcctccctagtgtcgtccacacctacccactcatacatatgtacgtaacgtcaatctctttagcttcttttctacatttttttgtatatgtaccaaaacgttgcgcatattcttcactcatttgctcccgtggctcggcggctatttttcttttcctacggagcggactgtggtgcttacgtgataacaaacaacccgagacaagatccaatcattgtctgactggtattcctgccaccatattaaaagataagacggtcgaaagataatacataaagataggtggaaattgagataaaaccagtccaaaaattctagatatatctagatatagaaccaatttttttttcccttgtttttgatatgttccttcgctatcctattacgttattcattcttgcatttctgattccctagacttgttgaccgcct

SEQ ID NO: 15262 - DNA, 500 bp, Saccharomyces cerevisiae
aaccgctgtgtaatgtagactactgtgtatagagataactctagcttctataggctcacttgcgaagcttttttcccactttttcccagtgaaatagtttcttattggcttttcatagtttgttctccgatttaatcgcaagcgccgtacggcgcaggcacagaatgacttgcagcttaatccaggtgcattttaagaaacttatctgctgggaagaccccgaagttcatcgtttacaatgtgccgtaaagaacacatttgagggtgcaatctggttcgtcttttgccataattagtagtgctcatccgtgatcctttaatttacttttgtgatgcgatgatttgcagatactatataagcaatggacaccgtccatcaccgatgaggctagaacatcgtagtgctttgtaaaagaactgttaaagacccagtacgaaaatttttccataatggaccctggtattgctaatcataccctccccgaggaatttgaagaggt

SEQ ID NO: 15263 - DNA, 419 bp, Saccharomyces cerevisiae
catacttcctgccacaacataatgtgaaatcacacgcgtcaacactcaatatatgtatggacacgtttcatttaggatttattttataggaaaaagtagatcaagtaatagaaaatcgaatcttttcaagcccttttgtcgcgtaaatacatcaatacttttatatacaaactgtaaaataagttaatgaagtggatagaaaaagaaaataactagaaaacataaggaataaagacgtaagggcaatgtttacaatactcatcccaatcttttccgtactttctcttacattttgcttggtctctgaaggctctgtgaatcaggacaacaaggaagaatactgggaaaaaccatgggaacaccgagttgaacccgcaagacaaggcccaaacgagagattgagtccaatcggcagtgta

SEQ ID NO: 15264 - DNA, 467 bp, Saccharomyces cerevisiae
tgtgtttttttagaagagaagagtttacaagtttgtaaataatctatattatagttgtcttgataaatgaatttacagtatgaattagttatttactgaacctatcaagtatgatactcatgtatgacgggaatgatagggaataagccccttctcttccttagttcattatggttcttattattcatcatcatttaagcaccgggagccttcgcgttacctttcaatctcaaaagaatttctttaagcttagacctgtctctacccccaatgatatcggcatcatcttggttaattaattgaagtgcacgatcccaggtcgtattgtcttgaccaaaaaattcatctcttttctttaagaaagcctcagcttccttagcagcatcttccaattgttgttccttctttttattgtaagaatcgtaaaaatcgtcaatatgtttgatagcttcatcctgcaattcctt

SEQ ID NO: 15265 - DNA, 499 bp, Saccharomyces cerevisiae
catgaatgatacattgttttgtacttttctttaatttgtatatatatatattaatttatatgtataagtaccatgtagttttctattcattcattcattcatcatgataatattacttcttacgtatcatttacgtgaatagatcactttaccgttaggcaattccattttcttttggcctttctttgcagaacccttttttactttgttccccttttttgtttggttaccatcatactttttactatccgttattatttcttcttttcctgcgctaccaacagatttgccaaacgtcatgttccaaaccgaagcaggtattctccaaaacaaacagttctttactgaaggtttatccaaggtatctggcgaaattagtgtttcacttccatcaggctctacaacatagacatcgctaaaccttacaaccaaacttttaccctcatccttttcatgttgtttaaacgttagttgttttacgcctagtccattggtatca

SEQ ID NO: 15266 - DNA, 414 bp, Saccharomyces cerevisiae
cttgtgacagggaggttattttattattttttcctttaatttgtaaatatatctataagagtatatatatatatatatataggtatacatacatgtgaaaatgtaagtacttttagtgttcttccttttcgagtatgttgaatatgaagagaataaataaatgaaggaagagggtgttgaactattttaaagtacctttaaaaaactttgttgaaagtatgagaagaaatgaaaggattttcctgaaaaaaaagaaggggtgttaaccaaacacatgttgaaatgctagttaaaaaagaatggtaaaacaatggaaaaggaaggagcaaaatctggtaaaaaagaagaaccataataatagtgaataaaaaaaaaaaaatgcaatgtaatgttgaatgtaatgcaaagaggggg

SEQ ID NO: 15267 - DNA, 499 bp, Saccharomyces cerevisiae
aaaataaaaggaaagcgagaagtatacacaagtgtatttcctagatatttacatcaaatatatatatatacttatttacaaaactctgatattataaattgattagatactatgtcggaacgtccagcccaaccacgtttgcagttcttttcactttctcatcctgtgtcaacttgttgccaggattgtatctgtcgaccagctcctcgtattctctttggttgtccaagaacttgatgatgtccaaagcgtgttcgaatatctcgtcaacgttttgtccctgggccacctttttctcccactttatatcgttttgtaatatggaacgtaatgacttagagtcggctataaacaaattcaaagatctgtcgcttaccggatctagttttttccatttctctaactgtctgttgatgttctcatgcgagtctctctgattttgtttcttagcatattccaactttgttatcattgcctttcgtagattgccccaattgac

SEQ ID NO: 15268 - DNA, 491 bp, Saccharomyces cerevisiae
gtataatttgtttcaacttcatttccttaagttaatccataagtcttttactgtatcttttatttataacatggatgaaaatagaaaagaaatatagaagtaaaaattaaagtaactgttcaatatacataatataattggaaagcaaaaatgcaaccaacaaaaatatacagtttctttttatcattgattcccttttagccttatttgctaattctggctttcatgatttgtaagaattctctgtaactttcgttattcaaaatcttatcctccactaaggtgctagaagcccatagtcttagcgttgcaacttccctagcagatgcatggttaacgggctcgctcaaagaggcacccctaacaatatacaatgattggtaagtgatgacatcatcatggtttctcaattggttgataatgtttcttactctttgattgaattcagaattttcaacaacaggtatttcctgtttgccaattggaatgtc

SEQ ID NO: 15269 - DNA, 406 bp, Saccharomyces cerevisiae
tacaagagacaaagaattacttgcagatataaaaagtagtcataaatatcagtttagtttactataatatatagtagtaatcacagtatacacgtaaacgtattccttttagcgtgaattcaggctgcgcattgaaaaaaacttccgtgttgaagaaatgacctgatgtgttgtatgttcggaattgatagaatcttgcacccaacgtgacaattttttccggaaattgggcctattatatcgcacatcgagcaagtaaatgtttgcgtaatcatttgcatgccgtatagcacgtccaacactttggttgacagctttcatacaaatattctccataaactcctttgttgctcgtgaagcttcctcttccgttccgcctgacttcattattttagcggccaaatgc

SEQ ID NO: 15270 - DNA, 463 bp, Saccharomyces cerevisiae
gaaggaaattaatacataaacgtgtacaagttatattctgtaacttttttttatacactatcacgcacattagggttctttaactttcagtaccttagtagttatcaactatgaaaaggtggttcaatgaatgttacgaaaggtttattatagaaggataagaagcaaaaatttaaaaaagaaatgcgtcacagacaggattcgaacctgcgcaggtaaaacccaatgcctaattgcttttctgaggaaatagcagggcatcgccttaaccactcggccactgggacagaatctcttggtttgttcaatgaagtaaactattttgttgtaaacataatgggtatgtttaacggcgagagaaaactatgcgaaatttggtataattgttgtgtttccattgttgttaaaggcattaacactaagtttacagaacatactagaagttgttttcggcaacatagga

SEQ ID NO: 15271 - DNA, 428 bp, Saccharomyces cerevisiae
ttcaatatatagcttggtcttcctattgttaactattgacttgtaaaccgtgttgtgcattcgctacgtgaatttaattggtatatatatgatagaatatgttctccagtttaaaaatctggaatcctattctactaaaacctcattcgtcatgtgagagatgcatgcaaaatagatttggtacgtttatacatatacatacatacacacatacacattgcatatctctatgtctatgcataatttttgcgcggtttataacggatccttcttagaggaagacaaccatgaccgttacattatctgttgtgccattttccaaagcatatctaaccaagacttttgcagcttcattaggttcagtaatatccttgattaattcgcatgcatcttgatcatcaataacatcccataatccatcacacgct

SEQ ID NO: 15272 - DNA, 408 bp, Saccharomyces cerevisiae
aaatcacataatatatgcacgcaatgacttaatagaaaaggagaaaaagcgcaagagcatcctttatgtgaaactgatgtctgatgctgttctttcttcatgatgcattatgtacttcaaactagattatctatatagtcttcttgtttctctaaggctactaaagttttatcttcagcttctttcacgatagtatctttgaactgttcaaacgtgccttctgcccaggtcaattcaatattagcctcttcatcggcgactttatgtgccagcagggagccagtgagtctgttttgcgaagggtcgttgacgctctttacagacatggtaaccacttgagcgcgttgtgatgaaggattagggttccttctggcgtcctcttgctttcttgttacatttgcgtcgtcg

SEQ ID NO: 15273 - DNA, 471 bp, Saccharomyces cerevisiae
caggcacagtgaaagatattcagtgtaatcacacggaaaaggtgattgctaatgatatactaaagtaattatcttcctcgttcataaaattaaataaagttattatagttttttcatccgttataatagcaaatgtatcagaaataagacaatttctcattttttgttggcagagtgagatatcatctgatctattgcaaatgaatcccaatcaatgctgataccgcttcgttataaccaattcgaaaagttgtaattatgttacccgcatgagaatattttgaagaagcaatgtagggctacgatagtacttttgagatggtttattacttgttcaaatgctgtcatctcatgttgttaatgcgctatatttcgcactacgaagctaattttcaacataggtaacacaaagatattagagatgtctgatatatcgaaactcataggagctattgtgggatctgatgaccc

SEQ ID NO: 15274 - DNA, 467 bp, Saccharomyces cerevisiae
tttacccaatgcttccaaggggaaattgtgaatgctttcgatttcatcattttcctttcgcattttcttatcgttatagtttaagtgtatattttcataactcttctacagaagaaactatacaaagattaaacaaccgtttttgtatcaggtcttatttgagcggctcaaaacgaaaggtaggattcacttatcttaccgccgtcaatagtatcccaagttgtaccttttcgtatatacctacaattctggcttcagacgcagtaatttttgagcaatcgtaacaaacggtttgcccctagagtttgaatttttcttcatcactccatgatagtgctctcatatattatcttacggaaattaatccaatataggtgcccaaaggttgaaattaatacgaactttgacctggccttaattatcgattctaatactatctgagtttaaagaacttgcggggaagaaat

SEQ ID NO: 15275 - DNA, 489 bp, Saccharomyces cerevisiae
aggaactgtataattaaagtagtgtttagatacgtaaattctgtttccgaagatgcaagaaggagcagcagcaccagaaaaaattactatttttcttctccattagagtctatgatggaatgccaaatgaaaaagccattttgttcaacagttcttgatctcgttaaatcgttccgggttttcaattgaaaaacaagggtaataaaatcgcatgagaaaaaaaaggtccagacacttttttagaagaaaaactcttgaaaacaattgattcttctacgtaaggacagggtattatctcgaattcttctccctggtaaatactcgggatatatagaacctattttgcatcctattctcacttttctttattgttgttaatttctggacattgtttcattaattgaatgaatgccctaaaatatttctcaaatcatttaataactacaaagaaacaaaaaaaaatcaatgttgaggtgacaaagaatcaag

SEQ ID NO: 15276 - DNA, 405 bp, Saccharomyces cerevisiae
cgagatttcacttcttcacgctatagaatgcacctaaaactcgcctgcactccgaaacgaaatgcgatacagtacgtgtcatgcggttagtatatatacatatatatatatatatatatattcaaataaattataacgtattaaataatatgtgaaaaaagagggagagttagataggatcagttggtcaactcatggtagtattcgtcataatgttgtacttcactagctatttctgtagcatcaaaatctgatgtgtgtttggtgtccctaatcaaatcagtgacttcgttcaggttcaattctaaaaagttttctaagaactggccaacttccgtattttcgtgattgccttgtaaattgttcaagacatatgaccatgtagctttcttattggcgtatgca

SEQ ID NO: 15277 - DNA, 491 bp, Saccharomyces cerevisiae
cgagtgtgactcgcaccacttcgtaggtagacatatacagaagtatatatatataatgcgtaattcccccacttgttactgttaagctaatcgaattgtcatctcagaaatcttgttcgagataaggccaatcttactaaaaaaatgtctattagtcttctctgttattattattcccggctttttgctttctttccttttttccaaggaagggggcaaattcgatcaactaaaaaagaggcatcgtttattcggatgccaccactgagacgatccacaggctaattgtgactagtggatcacagaacaaccaaaatgtttaaagtgtttggttttggtgcgaaggaagagattcctgagctttcacaggaagaaaaaactaaagccattctaaaacaagctcatgatttcgaacaggcactgcgtgcgatggactatgtcttagatgataatgctgacgagggtttggctttgctggatgagagtgatgc

SEQ ID NO: 15278 - DNA, 491 bp, Saccharomyces cerevisiae
caacactgaggagaacacaaaaaaaatagtggaatgtgatagtttgaaataaggatattagtttatactctaatatacaaatataaaagttgtttctttttcgttcttttttttttttggacttgtcttcgtttttattacatacatgcatgcgcttaacatattcccatgtggtttattttcgtatatagcattactttgtttagaagcttctattcaagaagaatcctccgacttaaccggatcagatacactattgtggtgtaatctggaccttgactgtctaaacaactcctcttgttgtcgtagcagctcttcttccgagagacctgacttcttgaacttggaatccctagtttctttcaccttctgggaacccttaaaattcaataatatttcctctaagaatggtataaactcattatactccaactcttctagcgctttgatcacgtgctcgggcgctatggttttcttagcctcgttgtccg

SEQ ID NO: 15279 - DNA, 434 bp, Saccharomyces cerevisiae
gaggtgaagaaaagtacaccgcttccggtatatatcgcctcctgattaagagatcaatggagagcacattaataagtttgtattaaagaattaagaactaaaaatagtgtatatgatgattatataagaattattaaactacccctattgcttttagaaaaccctgtcttgaatgagaggatgttttacacgcaacgcgtaagaaacatctttaaagagactagacatgaaacgatactgctcagggcaatttaggggctttcccacaaagatggtggtataacggggctagtctgtcaaaaagcctagaagtgaaaaacgaataacaaaaaaataacataatactgaaagaaagcattaagaaggcggatgtgtcaaacaccaccgtttataagaataacatagcaacaccagccaaacctaaagcacctgga

SEQ ID NO: 15280 - DNA, 496 bp, Saccharomyces cerevisiae
acactaattcatacagggtaatgagcaacttccttctatacttatttttttttagttctatatgctttataaattaatttgaatcgatttatttttcattatacatgtctagttttacgaaggtttgtaaatacatgagctatcaagtttataatcctttaattaaacgagtgacctcatttagaccatcttcatgaatttgtgataacttttcttgaacaataggaacaatgtcagccgcactaaccaattcaccatcatcatcggcaaattcttggcccaatcttttgacacgtaatttaccttctaagtactcctccttaccgaggattacggcaatgtgacaacccgctttttcagcagcatcgaattgcttcctaggattagccttggccttatagacatattcagcttcaatgccagcatcccataattgcttagtaaccttcattctttcgggtaaataaccagtccagtccttaccaccaccaaaagc

SEQ ID NO: 15281 - DNA, 496 bp, Saccharomyces cerevisiae
ttagacatttatgtaatttttaaggcgctagtatagattattcaaaattatatgatacagacttttatcaatttttacttgtttaagctccgtcaccctgttattaaacgtgagcagagaaatgccttttgaaaacacactaaaacacataagttaatcttcgcgccatttaccaacctttttgtattggaggtaaagtgctttgaaatattgtttcccaggtgtgtcaaggaaagcgttcaattgattcaactcgttctgagataatatatcaaaaatcgcatgaataccgggctgcagactcttttttatgtttaaactgaactgcgtcgtaatagacaactgtatatatttcgttagaaccacaagtacattttttctgatggactgctttatcaaacttatctttgagcttaagttatttttctgcccattttgagcgtttgatacattataaggctcgcagtagttcgttattagtctggctacggcgtct

SEQ ID NO: 15282 - DNA, 493 bp, Saccharomyces cerevisiae
cgttaagatttatgctcgaacttattatgtacaatgaatatttttcttttaaatcatttttaaatatttcaatttagtattattttctgtataattcattcgcgaggtataatctaccatccacttctctatcattatactcccatatttttttattcacaggctagacaatggtaatggtgctttagatgatttcagtggattacattcgcacaatagaataaatgactaattttcaagaatttgtttcaacctgccggcattcagttattataagttattgtttgatggtaaaacttcgccatcaccggttgctgcgtttattgcaaaattactgaaaccatgtaatttccgaatacggtaattacacgcagtttgaaatttgacatgcaagtttaacaaaaaaacttctgtccgcatctaaagcttaattaagggactgtttcataccttcagatccaatatactgaatatcaggcaattgatttccctt

SEQ ID NO: 15283 - DNA, 491 bp, Saccharomyces cerevisiae
tttcgttattctctccactaaagtaaaagaagtgaatacgttagttttatttttttttttttttttaattttttgagaagtgttttacttcgcaatgcatttatatcctatatgtcctggcaaactttttgataaattggaatgcaagttttaacgcgtttttatgtagcactaatacactgtattgaagatttttttttctttcacaatttggaaacgattatattggatatatattagaagttttcctcgaggatataagaaatccgcaaaagggaatcaacaattctatataacaacattattctctctccgtttatattttatattaaattcattatcttattaaattatcaattcttgcacttcagcttccattaaatccgataattgttatgaagtcttctaacaactcattcgacattaataataaagaatattattcgatatatttatttatttttattccggcaataataaatctgaaaacg

SEQ ID NO: 15284 - DNA, 441 bp, Saccharomyces cerevisiae
ttgaagaaataatctggtgaacattttctccattcattctatcacaacagactcacacatatatacatgtatatatttgtaactttgtatatatcttttgttttttgacctttttcttcctctatgtttttcagccatacaaaaatatgggatttttagcaagagaaaaagtacatctaaaaaaagtagtaataggaggaagccaagattggttgaaacacagttataaactcttcaaggcaattatgaacaggattttcggatatgggaacaaaaagagccatgatcagctcttacaagagtcgaatcagtccatgaatcaggcccaacaatcactatcgaacagaatatcccagttagatactcaaatcgcccagttaaacttccagctgcaaaatattcaaaagaatttgcaaagatcaaacaacaagcaaccctcgt

SEQ ID NO: 15285 - DNA, 467 bp, Saccharomyces cerevisiae
agggaatccatctttcccattcttcctccttttgtactttatttaactaatgtcgttgtgtaacaaaaatagagcaaaataacattatttacaaattctcaaaaataattttttgctctttgtttcttatgctaagtaaatagaaagatattttttgtaccattttctataagtatggcaactatatacactttaataaatctattggttagtagaattttcattcattttgtagtgaatgaaactatccaacgtagtaaagcaatcatggcatctttcttttagttcgggatttttgtttttatcaaccattttgaattgctgcctcaaatttggtacaacttggtcttttagaatagataaaaatccaccccttacaaatattggttcattatagtcgtaagaggcatccccgtaaatttggaaaagcgaatttgtcatttctatcaaaatttcagggcgaacat

SEQ ID NO: 15286 - DNA, 441 bp, Saccharomyces cerevisiae
aaatgttaagtaaaagggttgtttttttttttttggaagaaataaggaatccctttgactgctcccaaaaccctcagctagctcgagattttatatatatacattttttatttttctgtaaaacattcatatttaccattttttaagcaaaatattgttagtagttagttaaaatagcccaagcagcaatcaagcaaatatgagagtactttttctttagcacctggtacttgtgcctggatattgattcgaacaacatgccaggtcaaccgtattctcaattaactgttactttaaatgtccatacacttaataaaaagaaggagagaatcacgcaaaaatcacattaaactatattataatgttttatgaagtatttttgaagcattaatgtgagagcttatagagatacgacattcataattcaatgctttattggga

SEQ ID NO: 15287 - DNA, 490 bp, Saccharomyces cerevisiae
aaacttgtgggcgcaattataaaacactgctaccaattgttcgttttctgttcattaacacataaaaaacccttatgtaactatatttacaaagtaaatacgtatattaaagctattttaccactaccacagagttctttgtccagttgctagtattttttttttcgcgacgaggcaggggcggggagacgtgttgtttttccacggctttcggctcaccacttgaagaactataaaaggccgccaaatttatcctttttcacttcttccgttcgcttttttctgtcattcctatcgtgtgtttagtagtaggtttttttgttagaagaagttttatccgaaaactatcgaagacaaatagataaaaaaatctccctcgttctatttgaaactttaagaaatccatattaagaaaatacctacatctgctaaatgtctgctaacttagataaatccttagacgaaatcattggctctaacaaagcaggaa

SEQ ID NO: 15288 - DNA, 444 bp, Saccharomyces cerevisiae
aggaaaacggtgtttttaagtagtataaccattacacattaattctttacacattaattcttttacggtcctgctctcacgttcttccttattggtttatgtaaacaggtatttttatagtattcttttccagacatacagtgttatctttttttcttgctttcgtgccgctaaagagctgtgaagatcaaaagtgatttacgcttagttagcatgaatataaattctcagttgaaaagaagctatgttacatttatgagcgttgctttagtatatctatacaaaaaaaagaaatttttatacaatggtctattaaaaaaggcttccaaataatagttcagcttattccatgttgatgttagtgctttcaacagtggagctatcgttgtcatagtaggccgacaccttgactttgaattcagaagcagcgataccgaattgttt

SEQ ID NO: 15289 - DNA, 400 bp, Saccharomyces cerevisiae
gatggcgaggcgatttgttggcttaagagacttaaatgcttacgggtggttgctttaaaatataaaatatatatgacctaagtaaatatggttttttctcaggaccggattattcatcgtcactatctaccaaggcgcctctgcctcttttaacttggcctatcctctcctcgtccgagtctacctcctcttcatcagaatctatttcgccatcattttgcgttttagcatcttgctctgaatcactttcgtaatcactatcagaaccttcgtcaccatcatctgtgtcacttccacggccagaattgacttcttcgacggcgtcaaaccaatcactatatacatcaacaggctgtgataatgaatttatgcgcgtttggaacgactgcccacaaatctt

SEQ ID NO: 15290 - DNA, 486 bp, Saccharomyces cerevisiae
tcctagttaaattgcatttcgatatctatgtacacatatacagcaatttttttttataaaccttagtaatattatcagttttcattttatgtcatttgacctttgttgcatttaaatggccttaacttcttttaacttttcaatcaattcatccacagaattcaatttcacaccaggtgacttagtctttggctcttccatcgacactatctttaactgaggttcaatattaatttcaggaaaatcttttgctatatccaatttttcaataggctttttcttcgccttcattagtttgggcagtcctacgtaacgcggagtgttcaatctcaaatctgtagtaataaccattggtaaggaagcttcaattacttcttctccatcgtcaatttctcttgttacctgaactctaccattatcaaggaattccacctttgccgcatttgttgcctgtggccaatttaataaacctgccaacatctgacc

SEQ ID NO: 15291 - DNA, 437 bp, Saccharomyces cerevisiae
tattatataaaggacattcgagtaatttaactaatacatatgcatacgcgcgcgtatgtatttcagatacttaaaaacttcaaatcacgtatgaaaaacatattgtttacttgaggcgattacacaatatcttgtttttgacaagattaagaagcgaactaaataaagtgaaaataaagtcgttgtcttaatactttaaattgtccaagtttggtccgttaccagtaaactctggaaggatggctgcaaatggctcatcgatgaatctcactgggtatttttcaccgaagtcgttcaactcttgtaattcatcctttgtcaaagatgcgaattcaatactcgaggaaatcctaactggattcaaggatctcggaattacgatagtgccttgtctaatatggtaagaaattagcaagtcatttcctgtgacattgtac

SEQ ID NO: 15292 - DNA, 423 bp, Saccharomyces cerevisiae
acgacatgaaaatgctaattaaatacttctttttgttctctataaggtgctacatgtatgatctgagtatatatatatatatatatatatacatgctgtgctaggaataagttcatgtaatattttcagtgttttattgactgaaattcaccgatgggacttgttactacctgacttactcttattcctgaatggatgaatgttgagaataaatcgttggtcttatcgctttcattatcatcgccgatattgtgtccttgctcttcttcaactatgtcctcagataattccatgggttgatgataattgaacatcccacatggtgaagacggtattgccttttgctttttgagggcttcctcctcttcctcttcatccaaaacttcttcatgagatctcttactttgctgagtttccagcatg

SEQ ID NO: 15293 - DNA, 467 bp, Saccharomyces cerevisiae
ggattttttaagtcaccacagaaacatgtattttcattttcgaatattgtttagcataattgaagatgcttagctaacgatgtataaggcgatagcgataaagaagatatatatatatatatatgtatgaagatagcgtttttaaatgtatttctttaatactgatcttcgatcattttgagcttgtttggcgggaataccattcttaatatcttcagagacaagtaaatccacttcaattgacttttcgatataggtaactaattttgaaatgtcagtctcttgaacaggaatgcgtactattccattattgtcacctgcaatataatcaccaggacatattgtttgggttacgccatcactcgttaagattttcaactgtacgttagtgcctacggctttaacgacagcctttggagcgcaagatccaacaccgtaagcaaaaacgggatggtttaaagtccggt

SEQ ID NO: 15294 - DNA, 461 bp, Saccharomyces cerevisiae
acgaaggaatgaactgaaactattaaatattttccctggccgccacttttttgagaggtatgacgactctatgttatatatatatatatatatatatatatatatagcacaaaatttcatgtgatcaatctactaggcgaacacctaaattgttatttatttccatgtctatatccatttcaatgtctggctcatcttcgtcctcgttttcgaattcggattcagattcggattccaaggtagtctccaaatcacagtttgtcctacagttcggacacatgaattgaggataattcataataaccaatcttcttacacaatgaaaatgccaactatgggcacatggtgatataaaaatggcttggcaaggttttattttgtttagacaaatggaacagtcttcttgttctaaaccagtagttagtttctgtagattttttattcggctcaaggcttcttta

SEQ ID NO: 15295 - DNA, 411 bp, Saccharomyces cerevisiae
ataaatagaagaagtagcaaagtgcagtttttttttccataataaataaccatcagtaactaagtggccgtgaggactgaccacattttctttacatacagtaaagtaaataaatctatcaaatattttgattattacttttagataaaacccttctctattagaaaatctcttattatatcccagtacccatcttgaataatagtatcattgtgtgaaccaagtggaaattcgaaaatctttttgttcgaactaggacatgtttcgtacagtttcctcatgtggaagggtggaacgatttcatcttttaatccacttaaaaacaagaatggcgtctctgaactacagcttcccataaggccttctgaattccagatttcgtgacataaaagcgtaaagcgtttcaaaagg

SEQ ID NO: 15296 - DNA, 499 bp, Saccharomyces cerevisiae
gcatgagagcgtacacgtatatttatttaatttcttttattgccggcgtattgcaagtaatttacaccagtactaaataaaagcaggatgctcctgcatctgtataagtgatgccgttgtaggatttttaccatctcgactataaactttttgtacttgagtcttcacttccggaattttactgcgcgattttctttgatagggcccctatcgtagacgaaaagtgataattcccatcgatgagcaactacatacctcacttgacttaattgctctcctaaagaaaaaaaataccgttacttttttcattaatatactaccacaacaattcacaacgggtagttgtacggttagtttatatccgcattaacaaatcaaagtcataacaacgtatcaacgtagactatgcctgtcccatctgttactgtcactaccgataatgaatatgaagacatatcgtccttttcttctattgactcttacaaaccggagcccttta

SEQ ID NO: 15297 - DNA, 408 bp, Saccharomyces cerevisiae
tagatttccttagacatatactggtccaaatccagctatatatcgggtgccattgacgtatattttttcgaagaacttggacgacaaaaagtcagcctcttttttatggcgttctatcaacaaattttacatttggaaatgatagtgtattatctttaccatttctatagtgatatatccggactaatcttttagcggccataaataaatattactaatatttaaagtttccttctgatttattcttctattatattcaaaccagttgtggaaaagtgtgtgcctcttttatatggcactttatactgaatgatgtaatcagtttgcatggacgccaaagcttgtattttaaccaaggttttttagagtttggccgcttcaaagttaaagacgttaggcaattcgcat

SEQ ID NO: 15298 - DNA, 476 bp, Saccharomyces cerevisiae
ctctaatgtgcagttgtcatgcacatcatcatactaaacttacacgaataggataacatgtatgctagcagaatatatatgaaagaaaaaaattattgatgcctttaaacttatactattatactatattatgttatattatattattagttttatagatatattgagatatgttgaatatgatgacgaggatggtggtttaagtgtatggattgaattttctcttagctttcattaccttgattctttcttgatcttccttaaatttacttaacagttgattgatctcctgttttttacgttctctgacctgaaatctatagaaatctttctttgcctttttatctatatttgaaattggcttggccttattttcatgtttggataatggatttttgtttaatattttctttcttatggaattcaatgacttggtgttctttcctacaactaatgtgaatccatcctcatccact

SEQ ID NO: 15299 - DNA, 444 bp, Saccharomyces cerevisiae
cttgaagcttatattatgcgttttttctaagagcgccatagcatgtaacgttttttacatactagttagctttatctatatagtctactgtgcagcttaaaatacccaactcatgcgtctcattggacgagctcttggcccttggaaaggtgctatattagtatataggggaatgatgacaaaagcctcaatgtggcttgagtcgatttcttatttggcgccacagggcacatggagtttatttatcatactactaacataaagaaggtatgtaggcaatacaacaagaatgctggaaaagttaaggagtcagtaacagttcttgatgacagaaacatataaaaaggtgtactattgctgtataatcggccctttcatacttgtacaaacatagcacagtaacccagttaaaatatgtctcctgcagcagctcaaacagcaatc

SEQ ID NO: 15300 - DNA, 443 bp, Saccharomyces cerevisiae
tgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgagaaaaaaaatataaaagagatggaggaacgggaaaaagttagttgtggtgataggtggcaagtggtattccgtaagaacaacaagaaaagcatttcatattatggctgaactgagcgaacaagtgcaaaatttaagcatcaacgacaacaacgagaatggttatgttcctcctcacttaagaggaaaaccaagaagtgccagaaataacagtagcaactacaataacaacaacggcggctac

SEQ ID NO: 15301 - DNA, 420 bp, Saccharomyces cerevisiae
cgctttatattgagctacgcatcgctaaaattgtttatttcgtatatagtgatttaagcatgccattaatagcatatcctaaaagaggaaagtgtaaacattacaaattcttccatcttgaaattaagaaaccctgttattgacatcagaaaacaacagctttttattgaaaataagaaagtagttggccaaaacatagattatttttttgaaaaacttattgcaccagttcaattatatgtaacaaggtggtgcaaaaacaatgacagcatattcaggctctccttcgaaaccaggcaataataattcttatctaaatcgttatgttgaaaacctaggcaccaatgtgactccacctctgagaccgcagtcaagttccaaaatcaactcttcgttaaacatagcgtcgccaagtcattt

SEQ ID NO: 15302 - DNA, 412 bp, Saccharomyces cerevisiae
tacacgcagtaataaacagtgaaaactattcttttatacgctcaataagggcacatttggtgtgttaacaggtgtcttttctgtgtttgttataattttgcgctattattatataacgttatatttactataatatattacaacatatattacaacatatttcaacgctctcctgttactgcttagggagaagaaagaaatgtgaagactgctattaaatccgtacattattaaaatgtatggatttgttatatttttcttcagttttttccttaaccagattcgaaaagcggcccgcctagaccattgcggttgcggctaaagcgttctggagagggcttctccgctgggcggacaacagaagcgagagacacgtttcccgtctgggaggactcaccggatttgtccagtt

SEQ ID NO: 15303 - DNA, 417 bp, Saccharomyces cerevisiae
ctaaataactctaagtaaattaagaacaataataatcattatttcgatttttagtcctgtaaacacgtttgccaccgatgagtaacactgaaagatcagagaaagaaaaaaaaattctacctaatgaaataaataaactaaaaagattaaattaactaattctcatgttagtaggtcacgaattctttaattttgttttgtgactgaaataaatatgaaaacgataatgaataaataaataaggagaggcagcagaaatacgccaaatattcaaagggctttgttgttgaccgactaccaagtcatcctttgcaatgctttaacactagtatgtaagttcctaggcttactcaaattagtgatattatcgttgttgcttggggctagggaagtaggaagtggagtcaacgccgtatc

SEQ ID NO: 15304 - DNA, 482 bp, Saccharomyces cerevisiae
aaacaaaatttatacattacgtaacacatacgtacatctaaatacgattcaattcagttcatggtattttgcgctactcgtcgttgcttagtatctactcgcagttgtcataattaacgggcgcttcttgtaattaaatgaacaaaaaaacgtaacgtacgtacaatggctctaatttcatcctgccatcctaaaaaaaaaatcaaataaagcagactcaaaaattttcagcttcagttaaattttgataagtatatttgcataactcaaggagtttgtgcaaacggttttctttctttgtggtttgttttatttactttccaataatacccgtcttgttggtttaagtcgtaacaaaaggaaaacttacaatcagatcatgacgacccagcaagaggagcaacgaagtgataccaagaatagcaaaagcgagtcaccttcagaagttttagtcgatactctcgactcaaagtcaaatggca

SEQ ID NO: 15305 - DNA, 401 bp, Saccharomyces cerevisiae
ttctgacgtgtcgacctctatcttgttaatcattatataaattatacatagagattacatgttatttcaagtttgcgatcaccgcacaatttcttagtcattgttgtaagtgttctgcaaaaatttcagcttttgtaccttattttcacaaaattcaaacacctgtccgaactgtgttttaaccagtgtttttgaattcaagagttcagtaatactttcataattttttaaccactccatccaagacaaacaatggaggaatgaatctgccaaatcgtcatcttttctcacccccgaattatcttggatctctagtatatcacatagcttgaaacttttttttttggtaagggcatttcttatcctattattccaaactcctatgaactcgaccagttttg

SEQ ID NO: 15306 - DNA, 407 bp, Saccharomyces cerevisiae
tccctagaatagatgaattttccattataaaatagatacactcaaatttttgtatacttatccaacaaatcgttactttctccttttctttaataaaaagcaaaccatgaattttatttcttttccccattattagagaaagccaatacataatctacatatattgcgtgtctgaattaaactttttagacacatgacataggccatcggcttactttgtaacgcgtggttgcctatacaccgactattaagttatgactaatattattgctgcgcttccccacctgcatttttcttgtcgtctttgccaaaaggaaaaaaaaacctacgcagattgactctctaaaaaatgattcatgaccagacaattcagtaaacataaactctgttgcattcattcttctgga

SEQ ID NO: 15307 - DNA, 449 bp, Saccharomyces cerevisiae
gcttaaaaagggcattctctgtttttttccccttagacgacatttttatagttttcgaataatatgatataatgatgtatagcaggatcctgaaaagtattattctttcgacatatacatttggtccgacttacaaccaaaaaatttttgttcaaaaaatataggaaattttagaaaacgaatgttgaatgcgttataaataatacagaatgtacgtgtatataaaaatataataaaaaaaatgcaagagttatggctttgtaataaaattgatatcaaaaaattacccaaataaacttttaaatgtgaacacaaaaattaaatcaccgatgttgaatcccagaataaaaaacaaaaagttcagaaaatatcattactttgcttcctttttaaaaccttaattcttgtattgttcacggaagtacttggcggcttcgaccatatgagtc

SEQ ID NO: 15308 - DNA, 463 bp, Saccharomyces cerevisiae
gtagggtacattttatgagaagaacagaaacaacatatatagctgaatacaagtgtatatacgtaaacgtatacgatttacttaattttctacgtcaaaggccttcctcttctgcgagaggacaagatgtgaatatgtgaattatagagatgtctgcagtatggttttacccaaatgatcatggaccaactagggtcatttcatagtgtttaggaatatactgcggtaggacgaacaacaaagatgaccgaactcagattttcccactctgcacccacatcccgcaatctcttcgtaataaggagaaagctggccataggacaaagtataggaaaagagctcaagatcatgcgtcctacttaatctaagttaaactcgtcaacggggccacttctgtctcatccatatatatcatggcaacagcccccgaaccccatatacacatcgttaaggcaacagcacc

SEQ ID NO: 15309 - DNA, 444 bp, Saccharomyces cerevisiae
gaagtctaaatgagaaaaggtggttctgtaagagcaaaccttaccgccttatgatctttttcatttattctctgctttaaaattttgtcgtaataaaaatagtatggtaatagacttatatattattttcttacacatttttgtcatatagttatattccgaatgtttacaatcgaacccatcataaaaatggaccttttcgtattaccgccccctttgtagagggggaggaacggcaacttcttgactattacgacgtatcaccaccccgttagatatactatggaaaaaactattaaaaaccattataattcattaatgacatcggtcctgaggtagtattacgtataacttacctggctcttggtcatagctttttatccgtttacgaaaaaaggagaagaagattgggcttccgcggctattgtttggtttataccccgc

SEQ ID NO: 15310 - DNA, 416 bp, Saccharomyces cerevisiae
gaagattagtggacatgtaagcttttttttttcgtgatttttgttattattggtgtcgttatttaggtatacattattttcctacgtagaaatgttatccttaatgtttttgttcagtagttactttcatattatattatttacaaacattgtcaaatgcttttttttttatttttctattttttgatcattctttcttttcgtgttctcttttctgtcttaccagcgaagcaatcttcgaagatatatttgtgttgcgactgttttccttatttagatcagaacttcgtgcggtttgtactatggcaggatttttctcatcaaattcatcctcatcctcactagtttcaccttcacttttccattgaccttgctttgcatcagaaaaaattggaatatcggtcaacgagcctctt

SEQ ID NO: 15311 - DNA, 426 bp, Saccharomyces cerevisiae
acagtaaattataggaacaagaagcacgggtactcgtgttagagggtagaaccttttccatggcagttcaatcgaatatttattttgttattttacaattcaaaaaaatagaatgaacactttataatttaacaagatttttctttttttttttattgaaggaggtattcgaaaggatgaaagctaaacaagttatttgaaatatgcatacatacatatatatatatactgtgtatattcaaatggtggcctttagcccataccgaattgttttgccatttgttgcatttgtggatcttgcatcattttcatcatttcgttcatatcaggcattcctccgcccattcctccgcccattccgccaccaaacatgttcatcatattttgcattagacctggattttgcttcagcttttgttgtgcctg

SEQ ID NO: 15312 - DNA, 439 bp, Saccharomyces cerevisiae
agaagattatgagttatgcatgtattgtacttgtattgccgtattattttttacagttaaaaaatgtgtacatataattatatagcgcccataatcaaatcagctcatacgtcaatttagtaataaaaaaaagcccttataaccttttagttaagaagattcaagattgcgatttgattaacgtcattacggaaatgtaaggacacaattaccaagagttacaaaatcggttcagagatttaaaactgtcgaaaacactgtaatcataaagtttgaatgctttcagatactatctagcataaattgtgtttaaaaaaatcatcattttagaattttgttgacaagaacatctggtgaagcaggctacccctttttaaaatacgtggaaaaaaaaatgacgttctcgtcattgtcatcttccatgtctacgccttttcgt

SEQ ID NO: 15313 - DNA, 471 bp, Saccharomyces cerevisiae
ggtttggaataaaggttagttatatagattaaatatgtaattctgttttgtaataattttttttcctgtttcataataaagaatcgttaaaaataaccaagggaggaaacaagtgaaatgaagtatagaaaagatatagaaaataaacttaaatattcagtttacttgtgcttcttttttcccctctatgaaatatagcatgataagtgattgttcctttgtttttttcagtggatgtttcacctaagcctttggacaatccttggaaatatggccagtttcgttacagttgtaacaaagcctgtcattttgacagtccctggacatgtggccagcttgaccacaagtgtaacatttcaatccactaattccgtcctctttcatacagtccttagccatatggtttggaccaccacatttataacatgaaactttggagaatctgctggtcttctttggttcagggcattc

SEQ ID NO: 15314 - DNA, 459 bp, Saccharomyces cerevisiae
ccccgctatggaaactgtctagtagtgcttgccaccactcccacaggatcgtagtatgtaacttgcctttattacctacatacataataagctatactcatcgtcgttatttgcaagccggggaacccaacgcggcgccaatgcggaaggaaagaaaggggacaagaagttgatattggtggaacgttaacaagaaattatggcgttgaggaagtgtattagcgagatacgatatcaagcaggtttagttagagccactttgtgatttgaaattttttgagatttacttcgttattataaggacatacggtaacctaggctagttaacataattagttgtcacccttcgcccccctaccctatcggtctttcattttccaactattgattagtaaaattcaaacatctttgctccgattagagcaactgaatatactagggattttgggctattacgca

SEQ ID NO: 15315 - DNA, 429 bp, Saccharomyces cerevisiae
tttatagacgttgtggatatctagccgcatatcaaataattaaatgctgccattacgtttgtgcggttatatatgttggctccctatagggttacccatggaacggcgaaggaaaaaaaaaataattttcactgaaaaatttcaagagtctatctcatctcatcgtttattctgaattaaatactacatacaaaatctttttattagtaaaatagtgagatttcttcgtgaactagtgaaaagctatcaatattaccaatctaccaaagtgagatggaagaaacaatagaaaatgttgaagtgccttctagtaatgtctcaaaacaaaatgacgacggcctagatatgaagactttgtttgtgaggtctataccccaggatgtcacagatgagcagctggcagatttcttttccaattttgctccgatc

SEQ ID NO: 15316 - DNA, 408 bp, Saccharomyces cerevisiae
gctcggttttttagtgacctacatatgaagtacgaattcatatagttgtacatatataccgataataatatcaaacctctattctttggtctttaacttttctttgagtgaattacaataccattgttatatcaatcactatacacggctcggtggcgaaattgaaatttttttattttcttctctttcattatggctaggcaagaaatagcgacagcaaaacttaagaaaaaatgatagaacaaggtcccatccagtattgactagtagctaaagctagaaggtacacttaggtttttctccctgtttttaagtttgaaccattgataaggccgttcgcagacaagcttgctaccatccaattttccttcctctaaagacttaataaaggcatctaactccaccttt

SEQ ID NO: 15317 - DNA, 489 bp, Saccharomyces cerevisiae
ataatataaaaaaatgtagcaacggtaatttttataaagtaaattcccagttgtatacttttcttaatgtgggctatttgattacctccatcctttatctttgtttttgttgacgaacaactaaagcaacattctgtttactaagactcttatttaattccaagtgcagcaagaacaaattgccaaaagcgtattgttaaacttgttctggcagcatattatcgtaaaattaagtaacgtttttaaaaatgacactgaattctactttgtgatgatcaaacaacacccacctggtctgataaaaaaatctccgcgacggggaattgaaccccgatctggcacgcgacaagcgcccattctgaccattaaactatcacggacaaatttctgaagttttgtacttttaccagtccatctaataccatatattttgataataattatgtctttgacagtaacttatcatcaggactgttggaataaaaatca

SEQ ID NO: 15318 - DNA, 433 bp, Saccharomyces cerevisiae
agaaaactgaagggccgcgattgttcatttcttcaaccttcttctcctactctaaaaattcatttaagtctcttttttccatatatatagatatataacggtattttatgtatgcacgtataccccaataatgccactaatttactccgttttccaatccataatcagcaaagaccatatgtgatttcaaatataaaaaatgagaaacatgtgaatatgtatatatgttatgcgggaaccaaccctttacaattagctatctaactagtcctttttcgagctccagaatttaccatcacccttatcattccattctttgaatttgttcttggcttcatcgtactttttcaacgcttcatcgtacttcttttgggcctcatcttttaaagcctgcttgtcattgtcgaccttggaagtccatccagaccaccag

SEQ ID NO: 15319 - DNA, 488 bp, Saccharomyces cerevisiae
gagcgctgagaaatacaaggggaaatgaagatttaccactccagttttcttgctaacgaaaatgaatgcaattcgattttgatactttttttaggggaagagataatatcttcgtctaatacaaattcacaaaattttcaattttaccaactacaaaatatacaaacctctaaaaaaatagtttcttaatatataacataaaatagtttttctgttactattacttctatcactgttttcttcgtgtattcttatattttggctatcgttcagagttgagacaatttgcgagagtaattgagtagtaattttcgtatgttttaaaataagttccttccattgtatacgcacctctttcttctgttttcctttgaatcttgatctaccttacctattgaaggtgaaggcatcttttctcatttgatgaaacagcgctccctgggtgtaggggggcgggggtatagtagcgtaaatccgcaacggaaaaa

SEQ ID NO: 15320 - DNA, 442 bp, Saccharomyces cerevisiae
ttttcagactaggttgtcaagctcttgataaatgtagctcctttctttttaactgctccatgttttgggtctgtatataggagtgctgttttaatcgatataggttacatttgaaacttttttttatgattataaggtactatttaaatatttacaactcgtacagttctcttttgttttttctctttttctccttgctaagcacctttaaggtgaaaagaaacacatatcaatacactaacaaaaaaggtgcacgttcatagggtatcggacaataactatattactaagctaccaaagcaatagcgccaataacaaaagctttcatgttaatgttcagggatgcaccggtattttcttttgccgtgctgacagtatatgttgtgctttgtttagcggatgaggatgttccatgaatcgctgccgtaggtttggtggtaga

SEQ ID NO: 15321 - DNA, 458 bp, Saccharomyces cerevisiae
acaatctatttttgtttctaagcaagtttatcacgcaaatacataagtatatttttactttctattcttcctagtttatatttatttcattgtaactttcttagaagctcggtcctctcgctatatagtaggatctgcaacatatttggatgtgggtgggcgttctccttcttttttagatgtaaggtccaacacgtataacaggtgatacacatagaaagacacgtggaaataacagtcatttacgaatatttaaaacctgagcaactccgtcaaatttgatcttaatcttttctggggccccatctaattcccagaaagcccttcgaattagaaaccggatgcaattttggcttgatcaaatagtaacgcttctctccgggaacatcaacgtacatgttgataaagtcaggttgataattctgtttggattctttagcctctaagtgaaccaacgc

SEQ ID NO: 15322 - DNA, 445 bp, Saccharomyces cerevisiae
tgagagatatttctattacgaatgcagacggaattagagcttaaagccaagccttcttgagagaatttttagtcatacacatgaatatatatatattttttatatatttactaatttgaacgatccgaaattaaaaaaaatatcaattactttcctccatgcttaaaatttgaaaacttggtccttggagtagcccaaattgttcaagataccgatcaattcaccttggtccttaggtgacttcttctcacctgagtaagcgttcataaatggtgggggaccgcagacaaacaaatgtgtgctttcctttggacctggaacatgctcctgaataaaatctttggagatgaaactaatttcaccatcaaagtcttggtcatcttgcttgtcgtcaacaaagtaagtaacattgaacttgtcaggatacttttccttcaacgcatcc

SEQ ID NO: 15323 - DNA, 437 bp, Saccharomyces cerevisiae
ataggcgtcgtatatagtctcttcttttacataagaaataataatttttggccccgcaactttccttattttcgagagggtccactgcccgttgatccggagctccgtggaataggcgagcggctgagtggttctccaagctacggtttttacgtgtagccccatgtgagcaagccaaacaagggcccttaaaggcgtgactacaaaaaggggcgggttggaaggtcatctgcagcgagatacgaaaagattttttgccagatttgcggttgggcggctatttcggtattgttggggtaacaaacgttggggaagactgcattttcttacagctttttttcgttatcgcgggttgggcggctatggcgccttctcctctgtactccaacctgtcagagacaccaagctgtatataaagcaccttggttggatcgtat

SEQ ID NO: 15324 - DNA, 476 bp, Saccharomyces cerevisiae
gctaagaagtgttcgtatcgacatatatcggtgtaagaattttgtgtatgaataagatagaaaagcaaaagcaattgcttttgctaaattaattcagttagttatctatttatatgtacatgagaaatgggagaattttgagaagcgagggtgaaagtgttatatacgcatatacatgtatatatatgcgcatgcttatcacctatgggaaaggactaaacttttcaataattctcttgggttaccgttaccacttaggaaatatttttcgtcaatcaagttctcccacttttttcctgtgatatccttgtctaataaaacatttgattgtttgtagtaatcgattagttcgttaacttcctgtttgttcagtttaggaacctcgaattcggtgacattacctttttggagcaattctacgaacttcggttcatagtgatatctagtaacataggggtctactgggatcttgccca

SEQ ID NO: 15325 - DNA, 458 bp, Saccharomyces cerevisiae
aatatacataaatagaggaactttacatgtatccatatactgaaaaatagataaaacaatgagataatatttattaacttctacgtaaataaaaagttacataaggatcaacctttttttctttattttcttttttttttttatttttcattttcaattacaaactaagacataacagtaagcagtgctttttctgtgcatgttttcctctttttataatgatattggctaaaataaaattaacaaaaacagatgagtgatatagattatattcattacagttcgttttcctaactcacataataatagcttcctttggaacattatcggagatagacttatgaggtaagactttaccaccgttgatgtagatttcgtccttaacttcaacgtcgtcacccaagacagtgacaccttccaaacgacaccattgaccaacggtagagttccagcctacg

SEQ ID NO: 15326 - DNA, 491 bp, Saccharomyces cerevisiae
cagctcagatgccgtatctttccacacattttcctcattggtctttgtacctataattgttcatattatatatacgtttgtaacaaatcgataaatagcaacaatatttttgcttattttgatatcctgaaatccttttttttttttttttttttttttttttttttttgatttcatttcgttttttttttttgaacattatatattgtattgttttctccctgtagcgagaactaattgattctttctcctttccccctaaatactcaacagtactctcgagccattagctgctgcaatttcaaaaaatgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaaga

SEQ ID NO: 15327 - DNA, 400 bp, Saccharomyces cerevisiae
ccaacgatttagtgtatacttttgaattttgagttcagttttatagtgaagaattggaaagctttagttgtctactttcacacggcatatatcatttgacttaacattaataacatggttgagattttgaagtgagttcagcaaaaaaagcctctagctgatttatactctgataactctacatatttttctactagtattatatttcactgaactgacacccttatgtgggaaaattttttggcagaatgatagtgtgtgagagggaagaatactgcttatgtcaaactaataatataacttctgactgtgactatgagcattactggtatattagtttcttttgcatattttgaactaaaacagaagagcgttcctaggcttacacccagtaaagaca

SEQ ID NO: 15328 - DNA, 400 bp, Saccharomyces cerevisiae
ccctgacatctaagatacatggttgttcaggttaaacatttttttttttagtccttaaaaattgtgtaattcagtaccaaaaaaatcgatgtttgcttttattcttttcaaggccatacggttctaacgcaccagtaatcatcagtacatctgccaagatatatctttatcatattcttgaaaggcccgaaaataaccctccaagagataaaaaatttttctgaatggtaattggaaagataaaattctgttgtgatctttgaactactttatctgatctggtcgtaaccatcaacaaggcgaattatgcattctttgttaaatatatacatgtgatctttccgtacatatctttccgatcctcatgaaacaccgacacagctgctaccaaaatgtgtgc

SEQ ID NO: 15329 - DNA, 460 bp, Saccharomyces cerevisiae
gcagaagattgagaagactactacgtatttttttttatatgcatccttttttccacatatgtatgcgcggtgcgcgcgcgccattaaaagatttttttcttagctctttttcttttttctttttctttccactgagatgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgata

SEQ ID NO: 15330 - DNA, 499 bp, Saccharomyces cerevisiae
ttaactgcggtgaaccttcaatatctgtacgtttgaaaaatatttccaacgatatacctctatattttgatctatagaatatttaattgcagtagttttttatcagtaaggtagcgttgatattactagtgaaggtaactctatagttccttgacatgttctttagattctagaggttttttattgaatttgttttcccaccttatttaaactttgagaacaaaactagcaaaatcaataatataaggactgcgataatggcatagcttatgaatttattagcaactagccttctagtcattgtttttagtgtctttatacttttatccacatatgaatccgcttgaaacaaggtctgtcttgcattttccaaagtttctctctgtgaccttaaatccatcattatttgtgaccctattccttcagtttcatttgctattctactggcatcttttagtctatctcccgatttctgtaagattgcatggttgctcaacaa

SEQ ID NO: 15331 - DNA, 493 bp, Saccharomyces cerevisiae
aaggcttaattggaagttcaattatatactatcattatctatagttccaacttttctacgtttttctagcaccttttaaataattgttaaattaaaacattttcatcgaaaatcttcaaaatataagacacattgagcgatgaaataagccttatttgattagggtcaattttgcaatttattctatcacttattcattcactcgcttgctttatgttttgcttcttcctttttttgttttttgaaacaaagaatcttttgccttaactcttcattaggtgttacatcctctagttttaaaggcattctattaaacgggtcagtagagtcactaagcagatgtgctttgatcgtgcttctatcaatattcatcttggatgctggtaaaatgacaggatccttcataattgtgtacatcaaaggatctaagaactcgtcaggaacatcaccatactcaagatcttcctcttcatcagcctttctttgctcttcg

SEQ ID NO: 15332 - DNA, 457 bp, Saccharomyces cerevisiae
tagttttgtgtaaaatgtagcaacctacatacgtaatgtatatttctccttctttggtacggcgaaagggccccattttaaaagggtgaaaaaatatttaaagagcaagcagaccatccctgaaatgacatacttactacatctaaaaaaagtcatttttctctattcataaggagcaagaaacactagccaagaatagtcagtataatgtcatcaagacccgctaataaccaaggccccccaaacctccctgccagagataagtcgctcgtgcaaaggttcatggcagtagccaagagcttgcagtttgcatggtttaccggtcattccgtcgtattgatcagctccattctttacctgctcaagatgtcagaattttattacagatcggcatatctcggtgtcatcgaatctttcggtatcatcatttaccagcaatttttcacccgcaatgaac

SEQ ID NO: 15333 - DNA, 458 bp, Saccharomyces cerevisiae
gtgtagcctgtgtcggctatatatacagtattagtgactatatagttaattagtgacatatgccactagttttatctaattattgtgctgcgttttgcagtattcttttttatttgaaacgcgtcacaaaagtttcgcgtccttagggaaatggctggtttttgttttaaaatagtatattatccttgatgtaatttagcaagagtgtattgtaagggaacagtctgttactgccattccctcatcgctagatcccccttccctcgcttattccgttactttcgctttactgagccataaccaagcgcacgcatacatatatatatatatatatattgtgctgcacgtatatataaataaatcacgcgtacaaggatacgttagccaaattctttggatataacaaaacagctacaactcatggttaataatatcatgcacgagtacgtaccacccag

SEQ ID NO: 15334 - DNA, 465 bp, Saccharomyces cerevisiae
agctttacgcctgtcgctgaattgactgacccgaaattaagaactgttgacgtagtgaattacgatctagtttatatgtcataatgtagtaagtttattggacccttctatatgttatgtaaatgtaataattacatagttactgcttttgtacatagaaactatagtttcttaagtactaccggattagaggtttgctactatatgttttccttgtctcaagcattactgaaacaactctgaaacaatactaaaacattactcatatcatgcttttgggttaccacattcaacaataactcgaatacatttataaaaaaaacaaaactaaggtacaaaacacacaccacaccacatacgcgctgattggttttatggaagctaatagttcagacatagctcagaaaaataataataagtattatcaaatataactcatctggttacatgctaagttcttgtcaa

SEQ ID NO: 15335 - DNA, 482 bp, Saccharomyces cerevisiae
tactacgtggaagaaaggaaaagaagctgcttttctcatttaaaacatttagtttatatacttcgcctctggaggacttttcaatttatgcaatatgtgagcacttctctattctcgattaggtctctgatatatacatatacataaacataaagcagtaagttgggtctattatactgacaaccctgttacccgcattgaaattgacaggctgcccattgattggtcagtttcccactaacccgcgctggagctgatttttcatatttttaaggattttgttttagcacccatccgacctcagtcaatatatcctttcgcgaccaggctttcctcccttttgctgctaactggttacagattttcctatttttggtcatttttatctttgaaactgattaagctgaaaaaatttgagcttctttgttgtaaactattttgtgctttcagttttattctagctcgacaaaggtaacagacaa

SEQ ID NO: 15336 - DNA, 430 bp, Saccharomyces cerevisiae
ttgaagttccgtattcgaaagaaactaagagctttgcagtaatatatgatgaaggcagtctttttatatagtagcgcacattattcaatcctcgctaaagtgttcaattagtaaatataatattgtcataaaggtacatagttgaaaagggtatttttttaaaaatagaaacttacaatagtagacataaagggactgtttttaacgattataggtgtaagacaaggaaaattcacaaattaaagtttaaaactactgtagggattcttcttgatctgatttatcatctattacattctcatcataagtgaaatcgtattctccttcgtattcatttgagccatcatctattataagctttccctgaggtttttttgccaaggcatcttccacttcgcctgtactcgaatttagacgcgagcaaatcaag

SEQ ID NO: 15337 - DNA, 403 bp, Saccharomyces cerevisiae
atgaaatgatgcatataagtagcgctttttttaatattataagtttggataaaagttaccaattttttcgtaggatatatattttaaaggcactatattgaaaatatcatgcatgcttatataaaagcttttttttttctatagggtgacatttaggagcaataatttttactacaagctttttttgcaccttatatagtagtgaccttgaaattggtcttttgcaccagcgtactttaattccactaagtactgtttagcagcctgttttccagagcccacaacagttttctataaaattttcacatgcattatatagacatgatctacctaccaatttgatcttcctgccattgagatcagttctttcattacattgattgcacatttttaattggcgcct

SEQ ID NO: 15338 - DNA, 456 bp, Saccharomyces cerevisiae
gacatatctttattattcgatcattcgcggaatctccacgctaattggtccgcggagccaatcagatctatttaagggtataaatttttctttagtttttttgacttttcacacagaaattttagataaaaggaagtattatatcggaacataacgtatataggaactagctgagtgagttaaaggatgtcgacagttaatgttttgagatactctgcgttgggtttggggctattttttggttttagaaatgatatgattttgaagtgtaatgctaagaagaaagaggagcaggcacagtacgaggagaaattgaagctggtagaggaggcaaagaaggaatacgccaagctacaccctgtagtaactcctaaagatgtgcctgcgaacgcctcatttaatttggaagatcctaatatagattttgaaagagttattcttaacgccgttgaatcc

SEQ ID NO: 15339 - DNA, 444 bp, Saccharomyces cerevisiae
tgtgctaaataatagaaacgtaagtcatgtatctagtttaaacgatctgtatagataatgtggtgaaaaatccaaatttttaggagctgtctttctaagcccgaaggctggaaaaaatagtactgatggcaaagacatcatagctttaaagtccattgttctcaaaagaagctcaatagaccatgtcttctgaatcaggaaagcctattgctaagcctattaggaagcctggctataccaatccggctttaaaagcccttggtatacccgccttgaggctgccttctcgaaactggatgatcttttggtctgtgttaacagtatccatcggtggcatagcctatgacaaatacaagcaacgtcagattctgagccatgcaacagacttggtgaagcctttggcagaggagtccatggaggtagacaaagtgccacgaaagatca

SEQ ID NO: 15340 - DNA, 491 bp, Saccharomyces cerevisiae
caaccgtgaagacagggagttggaccttagcaagttttgtagtaaattattatggaatagtacaacagaatttttttttttctcaatatataattttcctttgtttttacttaaatctgataacagcgtcaatgtacatacaagtggaaattaaagacggaatgaaaatatcataagtgctatgtttattcaggctcaaaagcttgatctgaaacctctaataatacttccattgccataatttgaaaatttacatcattagcgtcatctggatttgcaggcgcaatagttggaccccaaattatacaaagagcccttaaattcattctgttttgggcttcatgtgccaacactcttttcaaatgaaagacaagagcccttaacgtccagtattgtgcgtcggggaggttatatattagtccgtgcataaaattttttcttgttgttgggtcttcaatttgtaaacaaaccttgatctccgatgatagggc

SEQ ID NO: 15341 - DNA, 435 bp, Saccharomyces cerevisiae
gttaatggcttcaactccatttatgactagtattagacgtgaattttttttgattagattacataaaaaaatatacagtaattttatttacatggatttttgttatagctggtatttttatatctttttttctgtttcaaatgcatatagaaaaattgaagagtaagtttatataaacaccttaattacgggattaaaaataaaacaagtttacaactataatcaccgcaaaagaactcagcgaaacaggagcaatgagtgagaaagaaacaaattacgtggaaaatctccttacgcaattagaaaatgaacttaatgaagataacttgcctgaagatatcaacacactattaaggaaatgttctttgaatcttgtgactgttgtctcccttccagatatggatgttaaaccactactggctacgatcaagcgtt

SEQ ID NO: 15342 - DNA, 457 bp, Saccharomyces cerevisiae
gttagtctctcggccttgcgatcgccctcgggactctcctctatacatctatataacgtatctataaccatgagcctatttactcataagttgctatgattgtacgtttgtacgaggtgacgcgttactaaactatttttttcttttggttttctgctttcctcttcgattttgccagatacgaaaaaggttaaagacacaataccttggtggcttctctaagtggggggagtttttcacagcaaaacacacggtcacctttcttattatggacggatattgggatgttgtagtgtcgtccttgcaagacatatacaatgccaacgaggtcattccctttgatgatgagctgcaaacaaaaaaactaaatttccttaatatgtcaaaggatcagctgcaattgcatctcaacactttccaagaacacatggaaaacgtcaacagagtgcaccgaatc

SEQ ID NO: 15343 - DNA, 421 bp, Saccharomyces cerevisiae
atgcgtttttaaagaagttaaataattcttaacattatatatatgctaaaagcagcatgttacactaaatacattttataaacaatagaaagtatgttaatacaatgcttttcaaagcgaccatgactttccgtacttggccgacaaaaaaacagagtaaataaaatgtctattataatcgggcgagaattaataaactagcagtttagcacagcagaatttaggcatacacgatggatgaaaaggtgtagccacacgaacctgtcgagatccctttttctgtctactaaatccacataggccagactatttcgtaaagatatgtcccctgaatgccgcagcttgctgtatttaccgtcacttctttttgctcagttatactggaaatgacggcctcggcatgccaaagttccagaaacag

SEQ ID NO: 15344 - DNA, 452 bp, Saccharomyces cerevisiae
ccgtcatataaagtagcacaaacatacataataagcctatatacattatacatgtgtaatggtggtggtacgcgaaaaattgcttacccgcactgtggcggtgaaaaaaaataactgatctcgacgacgttgaacacgtaattcgcattttatctcgaacatttataagccaaattgagtttcgaaaattgcttggttgcgttatacatagcattaaagtacgacggagtctattttctattttaggttcatcctttttttttttttcattttgcccctccatctccatttttcactcattctggtcatttcttcgttcagtttcattcacatttttgaactgatttcacctttcctccttttatcaacgtaatagcatattttctaacaacacagccattgccatgtcctcccaacaacacaagttcaagcgcccagatgtctccgttaga

SEQ ID NO: 15345 - DNA, 491 bp, Saccharomyces cerevisiae
aatagctctcgggcgaatatcgccttaaggaaatatctactaaataccgaatatatacatatatatatatcttagctacatatatatatatcttagcgttttaacgggcgtggccgtatcaatggatctgcaagatacttgggccctaccggtctagataaaatattcaaatcgatggtgatgacggcacgataaaacgtaataaatgatgaaatgacttgtcacggcgtagcagcgccagcagctcagtctaatcgccgtacagtgggtggtgtggctaatcgcttaggctttttattcagaaggaccttttcattcacctcgccccccttggaggttcctgcctgacccctttgcccctggcctcgcccctgcgccatgtctctgcctggagcgtgacatttaggacggtgaagctaggcaggccttcagaaattaaacggaacatgacagcaaagacgaaacaaagctggaataaggggatctgggaa

SEQ ID NO: 15346 - DNA, 491 bp, Saccharomyces cerevisiae
taagaacaaagtaaatatacgcccatatatgtatatatgtatatatacatatatcctacactacatatggaagctccctatatatatagcattgcgagtgaacttctatcgactaaagtgaacagcaatggggacgatgattacaacaagcaatatgatgattactaaagccagacacatcttcatttttagatccttgtaccacatggcttttctgaccctattggcacccctcttaaagccttgggctgagaccgctaggttatcggctttatcttcaatggacgttaatctttcacctctttctgctactttatttatgttatctctcattattcccacggtatcatcaatttcctaaaaataaacacgaagaacgtatatgaatgtatacgcataagtatcaacgatgtagaaagttagtataatgttaatttcctagatggtactctgtggctttctgtacttacagcttgtagttccgcagtcct

SEQ ID NO: 15347 - DNA, 424 bp, Saccharomyces cerevisiae
taattattctaccacttttccactgtttgtgttatatcctccacatacatatacatataatatatgtaaatctagttttgtcattgcttttattttatttgcgtacatcctagcctaacttctgaatcaaagagtgacgtctactgtcgcatgtttccaaagaaaaactctaattgtacatatcatgctgataattcctacaagccctaaagattcatataatactttgggcggccgggtgagagaacgcccgcgacctgaaaaattttctgtgattttttattatgaccttaatcgcgcttgttcaagatatattttcatcacaaatgtccatacatatatatatatatatatatatatatatatcaacatttgtaacataactcttctactgcagtccttggggggaacaaggataatagca

SEQ ID NO: 15348 - DNA, 413 bp, Saccharomyces cerevisiae
atctttataaaattgaaaagggggtataaacagtgagaacttaacataaaatacatatattcgtttattgctaagtaaactaaaattgatctattatttttcttttcttttcttttgcggctgggggaaccccttttaagacaaaataagacttttttcacccgtacatttttaacacccaattcctttccggctccaactttctttttttttcgaaaatgatgagcttagtcctgcgtccgcttcccaaagaaaaaatgcgtaagcctctttcacttcggcagctcactcttcccactttccctgtattcgaaggtaccgtaggcagaggcctatcctcattctcccactgtgtaaactaggcgttctgcctagcggctaagcgttctccgcgtattgtttcaccgttgggc

SEQ ID NO: 15349 - DNA, 491 bp, Saccharomyces cerevisiae
actttaatgtcgttctccctttttaaagagtaaatacatatttaaaaaagtgactatggctattgctaaacgtgataaaaatcagagcctataacactctctgaaataacgctatgcaggaatttccagttaagttcttcttggggtgacttctttactcggtatgatatgtgttttatatgcacagtacgagtccattagggtaaattagtggccgagaaacttttgccgccgagcttttaagtatccttttgccacttcttatttagataaagacctggcagtagtagtcgtagaagataagatagacagagaatgaatactaataagatagcacaagacgaagtccaagataaggttttgcaaagagcagaactagcacattctgtatggaacttaaggttcaacctcagtaaagttgccaaacggattcgcatggaaacaaaggtatttccagagataaagataaatgacgcgcaatcacagttaga

SEQ ID NO: 15350 - DNA, 418 bp, Saccharomyces cerevisiae
cttttaaaggaagaaggcaggttcatcaatatgcaattttcggtacaaaagtacgtatgtctataaaaatagagtattgttttctttgctatcttaatctacccagaattattccaaggagtttcagcctcgatttttttttagtttaatggcgtatagtccagtttcaagaaatactccacctactaagtgagtacttaagaagtggttcctcgaagctttccattgtgattatataactacaaacatttcgtaaacatagctgaataaggaacccatcctcaacttcataactctaaaaaaaaattctatatataggaacgagacatatggaggacgataatttaagaaactctaacgtagtttgcagggaatattccttcttttccgttagtcctgcctgtccaccaatcatttt

SEQ ID NO: 15351 - DNA, 405 bp, Saccharomyces cerevisiae
aggaagagactgtcatagggaagagccctttctacatactactacataatatatatatatagtatagaaattggtatatcactacttgtacaaatatcatattgtacgataatcgcgaagaacgacgcactggtgggaagaagtggaaaacagaagctttaaggtagaaacagaacaagaatgtggctatggtaggatagcaaaagagtaccattgctgttatcatttgttgcctagccctatcaagacctgtctgctaatccaacccgagagatcatggcgatccaaacccgttttgcctcgggcacatctttatccgatttgaaaccaaaaccaagtgcaacttccatctccatacccatgcaaaatgtcatgaacaagcctgtcacggaacaggactcactg

SEQ ID NO: 15352 - DNA, 402 bp, Saccharomyces cerevisiae
gccctttctagtatctcctttattcgtttttattcgttacgattttccggcttaataatataggattgctaggtctatatataagaaaagcttgtagaaataaaaaaatagaaaaaacttcaagataaatattgttctcttttattttaagatcctacaaacagcacaattccccttttagttatttttagccaagatcaggatagcagagaactgagtcccttattctttaattgagggtcaaaaaattccgattgcgaacttcatctccaccttggcaaaggaatgacgaaaaaatgatcttgcatatatatatttacttgtaaaataattattttggaatttttcttaacaaaccacctgacaaacaaacaccgtacgcaagcatcccgcaaacattag

SEQ ID NO: 15353 - DNA, 403 bp, Saccharomyces cerevisiae
taatttggttttgcgctaatcgtgcgcctgattttttttcctgccactcttatatagttatttgttattattctattatttcatctattgtttgctagctattatgtacgttgctgtttgagcactatatacaattgaataccaaagaaaaaattataaaaacgaaaaaaaaaaaaaaaaaaaaaaatttggttatagctcgatcaagagacaataaaagtgaatatacatggtgccaagggaaagtcctagcatgtcaaacagtcatcatacatcccagggaagaagaaacaaactttcagtgtgggttaaaaaaataataaacaccactaccacaactaacgcatcggtctcgagcagtaaaccaagacgcggcactagggctggccccacaagagttaag

SEQ ID NO: 15354 - DNA, 490 bp, Saccharomyces cerevisiae
atgtgacgtttcctaaaagaagtagcctgtataatatagagagattttatatactttcttaatgaattagactgtttctacaagtatttgacactggaaaaaaagagaaagtacatagagattggccaaatatttaaatctacacagttgcctatcgtttatcgccttattcttcagaaacatttcatcaactactctggtgcattatttcatgttagttaccatatataccggccggccgcatcggggttttttgattgaaaaaattggtatattttcagtacacatataaataaaaccctcaatttgcctctccaaccgttataactattccagatcctctttaccgagcaagtaggctagcttctgtaaagggatttttccatctaatacaatgagtggagtatcaaataaaacagtatcaattaatggttggtatggcatgccaattcatttactaagggaagaaggcgactttgcccagtttatg

SEQ ID NO: 15355 - DNA, 496 bp, Saccharomyces cerevisiae
ttgccggtatattaacgctacgtaaagtacatcatgtttaccagtttaaataaacaattttaaaaagaaactctattacatctatctatcattattttcttcattgtctattgtatatttcatcatcggtgtaaccaagaatgtataaaatgtcagtcatgctcttggtattcaacttacaaggtgcagctttctgcacctttggcttggcgttccatgcgatcccaaacccggcggtagccatggctggcaggtcgttaccaccgtcacccaccatacaacttgcttcaactggaacattgtagtcattacatagttgcagaagggtttcactcttgcactgtccgtctacgataggacccagtgttttaccggttaattttccatcagtgtcaacttccaacaagtttgccttacaaaaatctaaacctaactgatccttgataaaaccggcaaactgaataaaaccaccgcttaaaacagcgagcttgcaatt

SEQ ID NO: 15356 - DNA, 498 bp, Saccharomyces cerevisiae
ttgcagtgtcttgaatctcttcctcgttaggaatgaagaaaaaaaaaagttagacaataattcgtgtaggtaaaagcgtatataaaattacatatataatttactgcaatatgtcaaagtgtatgaaaaacatttgaaagtaagttcccacaggaactggaaaataagacaacaagactgtgacttccacacgcatctgtcgtttttggccatctactcttccttttttgaaataggctttggtgagtaaccactaaaactcatttttctcacacgttcacctgatccacttgcagcgttagaaaattcctgcttgaatctttcaaaagctttagaaaggttttcctcttctatttcaagaccatttttatttctccattctttgtaatctttgcagaaatcttcccaatcttccttagcattgtcccacttttctaactcaattggtggaatacctaagttcatttcttcttcttctgctgtctttcccttttcatg

SEQ ID NO: 15357 - DNA, 498 bp, Saccharomyces cerevisiae
taaaaaaaatgtaagaaaaaaaaaatcaggtattgttgaattattatttacttattctttatgtactcgtttgcttattggtttagtgtagcatttggctatttttggatgactagaaaggcagatttttttagtagaaatactcctcatcttcatcgatttctacatcctctgaatcggcagcaaggttgcctttaaagttcagtttcataggattgactttctttttctttccgaacatcttaactttgtgctcattcaatttcaatgagcatggtgataccagcctgtcagtcggtgatgcaaatctttgttgtagttggagtttcctcttcggatcctgttttaaaagatcccttttgaacattgtcttttttaccaaattgctagtggtgtgtgacgacttcaagtttgaagtgctttttttcctaaaaattcgaaaggccgcaatctcctcctctaaattaggtatattctctttattggcgtcctctcctg

SEQ ID NO: 15358 - DNA, 405 bp, Saccharomyces cerevisiae
taaagtcgaaattctgacgagtaaatattattaattagaagtacaagaagataacatcagaatggcttatcgtttatatataactaattaacgtaaacacagtcagccatatggctgtaacacttgacatttcgagaaatcacataataagcgttaaatataagagacccttctctttccctaaaaaaatataaaaaagtacaggttgtctatttatctaatgggtgattcagtatacaaactggacgacgaagagctgtggttccccactggcgttgaacttgtactaccacctccaatagtaccgttattagacgatggtggtccactcgatatacttccctccttttgtatcaacgtcgcattatctactacaccagcggttgaggcagttgacggacaagt

SEQ ID NO: 15359 - DNA, 429 bp, Saccharomyces cerevisiae
taaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttgggcgtatcttaattactctggctgccaggcccgtgtagagggccgcaagaccttctgtacgccatatagtctctaagaacttgaacatgtttctagacctattgccgcctttcggatcgctattgttcatcatggatatttgccatctcgtcttaccgacatcaaaagggtgtgtgcatatagcagctatcatcccacttatgcaaccactggcaaaactgtttataaaatggacccagtttgcgtccttaga

SEQ ID NO: 15360 - DNA, 490 bp, Saccharomyces cerevisiae
aacttcaatccaataggaaggagagaaagaaggagatagggaacttttttccctgtaccctacactttctaccctcttcgcggaaatagtactaatgagaaaaacataaataatattttgctaatcaagacatgtatggcgtactggttattagtagatatataactgcaaatacacacatacatacaatgtatatattttgtttttacaaaattgaatgagataagtactgtgcacattgaatgagttcctgtttcatggttagaatacgcacatatttattttcttttttttcttttcgacgacaggctgaatgaaagaaagaaaataaagatactctggcatgcgaaaataagtgaaaaataaatcggctataatgcgtaagctactgtgggaagcagaagcaagacctaaacgtttggtgaggcagtataatataccatagttatagggggataaaacaaaagtaggcatggaacctaagcgaaag

SEQ ID NO: 15361 - DNA, 500 bp, Saccharomyces cerevisiae
aatatttggggcccctcgcggctcatttgtagtatctaagattatgtattttcttttataatatttgttgttatgaaacagacagaagtaagtttctgcgactatattatttttttttttcttctttttttttcctttattcaacttggcgatgagctgaaaatttttttggttaaggaccctttagaagtattgaatgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagacaaactgg

SEQ ID NO: 15362 - DNA, 401 bp, Saccharomyces cerevisiae
gcgcattagagagaatataaagaaagatgatgatgtaaggtatacgtacatatacatatacacatacatacatatatatatatatatatatacatatatgcgtataggcagagccaactaactaatttgagcacggcccgtaataccagggatggatattcttagtctatgcgtaattcccagcttaggaacgacaccaataagcaccgtcacggcgaggttggagaggaatagtgtcatgtcgttgcggtagtactggttgctaatcaggaacaacacaatgggtacaatcagcagaaattttctagtgggtgtgtacaaagtctcatcgttaatctgctcccacatggtcaggttgtcgtacgcaccaccgttaaagtcgaagggcgtacctttgacaa

SEQ ID NO: 15363 - DNA, 485 bp, Saccharomyces cerevisiae
tagaatttcctttgcggaagtatacctcgagtaaagaaattcacagataaatttgaataacgttctccattatgaataaatatgtatttacaagcttagaaaataatgtgctctttatttaccaaataatacagttctcattgcagtaaataagctttcctttttcttaccgtcaacggcatttattaaccgttgataatattggggatttcctgcaggtttatagagcttatcgccaatatcgtaatagtttctgaatttattattcattatagtgctcaaggcacgaatttgctcgttgatgctttcttccgtgaatttctcatctaccattttattttgaattttggttaacatctccttattcagtcctaatggaccggaagttctgttaattatactttttatttcatctaatgagggttttttctcttttatagattttcctttgtcatctacatttggcagacccgctacacgtctaa

SEQ ID NO: 15364 - DNA, 404 bp, Saccharomyces cerevisiae
tagaactaacgctaatcgataaaacattagatttcaaactagataaggaccatgtataagaactatatacttccaatataatatagtataagctttaagatagtatctctcgatctaccgttccacgtgactagtccaaggattttttttaagccaatgaaaatgaagaaatgcgtgatcggaaattacgggtagtacgagaaggaaacttgagccaccccccaaattttattcatataataataggaaaagcaacgacctcatctctcgaacattgtttacttgagcaagtccgattaagagtaagttgtcgtacgttaaatacaaataatcaacaaaacactacacaaaaacttctacgataatgggtcctccaagcggtaaaacttacatgggatggtggg

SEQ ID NO: 15365 - DNA, 430 bp, Saccharomyces cerevisiae
aaggtgtaagttaactgaaatgaaaatttcatatttacttttttattgttactcatttgtaattcataaactacatacactttcaatcgtttctttcaaactacataatttttactggcgatcaataacgcatttagttcataaagtgagtcaaagttaacactagaatatttgctacaccatcaataggctagaccatagttgaaaactttcataataaattcttccgttttcaatcttcatatactgtgtctctaaccatgataccgtgacacaactacatccgtacacatgtgacgttcgttcaacccgtacatttatataaaaccgttctggcggccttttatttttttacatttcttatgatcgggattgcagaacgccgtgaaatttttcaatgtgaggttcggccttgtttgcaaaagcccta

SEQ ID NO: 15366 - DNA, 436 bp, Saccharomyces cerevisiae
ctctgttgtcctactatcgattatttgtgccagcgggctctgttaggttgagggtggaaagtgtagaaaaagcagacctatttgccagcggatacatagccacagctcatacataaaattttcatacttaagtctaaacacaataatatattttttttatcgaagacatccaaaaacttagtaatcgtcgtcaccaccgtattgattacgaccgcctctattagatgaaccataagagtcatcattgttggatgaaccgtagttggaagacccataggagttcttgtttctattagaggaaccgtaagagtcgtcattgttggaaccgtaagagtcattgttgttgctggagccgtatgaatcatcgttgttggaaccataagaactcttctttttgttagaagaaccgtaggaatcatcgttgttagaaccatac

SEQ ID NO: 15367 - DNA, 401 bp, Saccharomyces cerevisiae
tttacaagtatttcaacacactatcgtacgtagatttagtagtcttctaaaatagtactataaacgatgttctcttagcagaattcgagttattattgtcatatactacgaaaaacctgtagattcaacaataataggttggtataaaagaatgtaaacataaggaatattaatctagtaatttttttctcatgaggttgagaaagcatctaaaatagcaattagcaaaatggagaagatcaaagagaaattgaatagcttaaaattagaatctgagtcatggcaagaaaaatatgaggagctgagagaacagctcaaagaattagagcaatctaacactgaaaaagaaaacgagattaaatctttgtccgctaaaaacgagcaactcgacagtgaagtgg

SEQ ID NO: 15368 - DNA, 497 bp, Saccharomyces cerevisiae
gaatacattccttttaatgtcaaggtgaagctatcgcctagcttcccattcaatatttttcatatgttatatagcaacatattctataaaagcctcactaatagctgtgctgcacgtatggtaattaattcctgattcagagaactcagaaatccaatacgtttgccttaaaatggaggagcaactttttctgtgctaaaagttgccgctcatgtattgaaggcataataaaagaaaccaaataatttgtagaacaaaatggcagataattgtgctagaagataaatacttatatatcgcaccatcgttattttgagttttcttttagtagttcgtgtgattgcagcaatgcgatctttatcctcaacctcatttcacacaaaatcaagactatgatgctgttcaattttactagtccgtgtccacttatatatatgcaaaagtattatcaaacactttagaaaaggaagaaaatgtttttgaaataagccaacatg

SEQ ID NO: 15369 - DNA, 500 bp, Saccharomyces cerevisiae
atactattgagtacaaaccatcattcaaggtaggacacttagtactatatcaaatatataatcaaaaaaaaaaccctcgaaggtcttttttatcttatttactgctactacctctgttgctagcattacttcaagatcctaaactgttaccccacccccgcaccatatcaaggttaaaaatccgatgtggcggtacttatttggttatttatctcatttacattaatatgcgtacgggaatggccttccgctccgtggaggataaagtgcggtcattttattatttttcgaaaacaatggctacaatcccttgattatctcacatgcgattacaaagcaaaagagaagattcgcatgcaggagccatacacgcgtcttttttaaggtatttccacgatctcgcggaaaaacttatagaacgaacaactattgctttaactaggaaagaataagaaaaaatagcgatcatactagaacccacagtcgaggcacaaggattt

SEQ ID NO: 15370 - DNA, 435 bp, Saccharomyces cerevisiae
cggtaggtggtaagcggtatatgtacatatacatatatatatatatatatatatatatgagcgtgtgcatggatgtacaacgataacaaaagcaggtacagggtatcaaaatattttatataatatagttacttaggatatttattattaggtctaaaaagaaatattacgaacaaacatgatatattggtgtagcggaaaaggaagataaaggagggagaacaacgtttttgtacgcagaaactaagcaataacacatgctgggtcccagaagacacctttgataatatagttgtccttcttttcactgctggtcttttcttttggagcggcggtagcggtagatggttgcatttctattcgatggctttgtacttattttggttttatccgagaaacagttacagatccctctcattaattcatttctggcgg

SEQ ID NO: 15371 - DNA, 452 bp, Saccharomyces cerevisiae
taattacatttttttcttcctttttttgggttatttatttagtcattttaaataagtaaacacaaagatatacttatgcgcattatgggcacacttgcgtgttcccgacaagcacttaagcgttcaagtcagcaaactttgcaaatctttatcactttgcaattttgtctccaaattctttctggcttgccaaaccaacaatctctttctctcttcaatgtctaagtccttaaagcttaagttactcatatcttcattgagatccacatggaatttatcgagtagattctcagcgcaaatcatgttcttctttctgggatcgttaaactctccgccaccagcagcgttattatcaacagccgcattggcccccattggcgccctggagggctcaaacccaggtggaaagctgaattcatcaccacgcaagtacctttccactgtttcctcga

SEQ ID NO: 15372 - DNA, 500 bp, Saccharomyces cerevisiae
tgataagttattatgtacaagcatcggtttagttcaattacattaatttaatacttgaaaagcatatttggcaatatgcgctatatatattctgatgtcatttgcttctatttacatttcattcattttttttctctgaatccttttttgcaatttttcttgcctctccttctttctcaattcctttaacgccctcttatcgttgttttgtggtttaacgtcctttggtataagtttcattatcattttcgagttcatgttacctagcagaacaggatcattagcatattcgctaactatctctttcaatgtctccaagacagcagctcttttctggaaaactgattctggtagcctgggtggttcacctttttgagagcggtccagctcctcaaaattttcaagccaattgtttgaatttatgttattcttgtcatcaagatataacgttactttattcccttttttcaatagcgaaactatttcgtgagccttctgcc

SEQ ID NO: 15373 - DNA, 467 bp, Saccharomyces cerevisiae
ttcatattagtataggatattaagcacatatctagacatatatgtacatctaaacaaatagctggagctatctgctgattagttttactctaaaagtaagttgttagtgtaactatgatcacggctgcgtgccgggtaataaatcaattttgaggaaaactggaagttcaccactgagaatgatcaacggcagggaaacgttataccaaacaaagcattctacctctagggaagctggaaacttgaattacccactatagcttgtcttttagtgatccattattccaacctattgcaattccaagaaaataaactaggaacttttttttttggaagaataagaaaaggagaaaaagtagacatactgtatatacacgagggcgtatcgttcaccagaaagaatataaacataacaagataaacatgtcaggcttgagaactgtttctgcttcatccggtaatggaaa

SEQ ID NO: 15374 - DNA, 486 bp, Saccharomyces cerevisiae
ggattagattagtaatagtttacgctaatattaaattgtttaacaaactaagtagtcaaaaaaaagaaaaaaaaaaaaaaaaaaaagaaaaggtgacattatgcagaacatattttatcgatccgcttatgtgcacacagtttgtccagctaggctagaatattatttattattaccattattattatattattattattattatcatcatcatgaacctgatgatccgaattgtgaagcccacttttcgtacttcactaatccgtcctgggatacagagggcttgatatacactaaactgttcttaaaatccacaaggcctatgggtcttatcatctccctctctgtttctaataacttatcacccagatctcgtagtgggcccatggcagcatccttcgctaaagacgttatatcacttcctgaatagccctcagtaatctttaccagttcatcaaaatctgattcggttaacgtgtgcttttg

SEQ ID NO: 15375 - DNA, 405 bp, Saccharomyces cerevisiae
tacataggaacgatacataaatagtacgtttatatcttttttttttgacaagagcaagtgattttttttatcactgtcttctttaagggatcatttatcatggtgagattttcttttcaagaacctcgagaatttgctacgtttcttctctttttcgggtggttctgacttgagagaacctgctgctttgggactagaagtaccagacttaggactattgtcttggctttttaaatgaacatgagagactggttgtgccaccggtttcatttcccttagaaggaaatcaggcgggtttacttgctggcgctgatcttccttgaatttgaaaaattctctaggattttgtaaacgttccacttcatctaagaattttgttggtgttaatatctcgtcgctgccaat

SEQ ID NO: 15376 - DNA, 435 bp, Saccharomyces cerevisiae
tccgactagtctctttttgtctcaataatctctatattttactaaaaaagaatatatatatatatatatatagcagtgtgatgactgttcatgtacattctaataactattcctagctgcctatcaaagactttttttttgaattagagctttttagtaatcatgggacccttttttcttttcattatccttactatagttttttttttttggaaaagccgaacgcggtaatgattggtcgtataagcaaaaacgaaacatcggcatggcgtaacgtagatccatctacagggaagtttttagaaatcagatagaaatgtattttgagtgctgtatatattgcagtactttttttctctctaggatttaagtatgtttagtattaactcatatcacattttttctttgtaaaaagcaaccattcgcaacaatgtc

SEQ ID NO: 15377 - DNA, 467 bp, Saccharomyces cerevisiae
atctaggtatttttatcttatacatatagaaaccaataaaaaacttgaacttgtactttcccgagtccgaattggttattatgagaagctattttttttttttacctctttttatatgaatcaagcgtacataattttctctataactattcttcgacatctatttggtcgttaggctctttctgttcttgtccttctgcccattgtgttatatcatcgacatacgataatatggtttctatactgtcaggattattagattccaaaggtaaaaattgaaccataccgaaatcatcgacgaggttggctatgcactggttcagtcttagaaatttagggttggatgcttgattcattccttccgtttccattaataacattgcatcgggattcaaaaatcttttcagttttttcttattgatgtcgccttttatcaagtctagtttgctcaacacattgatatgggg

SEQ ID NO: 15378 - DNA, 468 bp, Saccharomyces cerevisiae
gctgtactttgatgaatggtaaaagtttatattatatatgatagaggatataaccgttattcattttctgtagattttatcattttctttgtcttcatagtatacaatttttttttatatgaattaatgcttgttcttgtctatttagtagttaaactcacttgctatttgcttctctgccatacgagccatacgaaacattttatttttagagttttccttagttggcttcttttcactattaccatccttactactttgcaatcccatagcctttggcctttcacgtaacccaaaacttttagctaaatggcctagatgtaagaacttcacgttgaaaaacttcttttcttgagagatatgcgttgcgtaagccctcacatgactaatgaaacctttaacggccaaatttttgaatgcggaatctcccactactcgtctttctatattcaaatgccatgtcgtagc

SEQ ID NO: 15379 - DNA, 493 bp, Saccharomyces cerevisiae
gaaatgggccaaccatgcatctctcttgctgtccactatgtatctacatatacgttttaaatatttatcatcgaatgtgcaaatacaagaacgtcactttcgagtctaagtggttgtcactcatgtttcgtgataaaagaaatatttacaacccgggattttgaaccgttgcatggtcatactcgaggagtattagaatcaagccattatgatctgctatatatcttaatggtaagatcacaatataaatggatagcaataacttttgagtatgaggagttccactttcataaatgttatagatatggaaagcttacgctgatgtaagtaatgagtaatcacaaaacgaggtaagaaaggccaagcgaaaataaagtcatatattttaggcaaaaaaaaaaagtctcaagtaattctctataaggcaataaaaaaatagttctcattcagtcttttttctttctttttgaatacgatggctcgattaaggttc

SEQ ID NO: 15380 - DNA, 475 bp, Saccharomyces cerevisiae
tcgaactgacgtttacccgtttcttccgttttatattatatgttattatataaataaaagctgttcatttctttcttcttgaaatatgactttacctatctcgataaaattcatttgtggtcgtcttcattcactcctgggcaatgctcgtagagatcaccttcatccttatacttgattccgcaaaaaaaacagtagtacttctcggacctcaggaatatattcaattttgttattcttttttcaatgctcaattcttctaattcagcaagttctgtgtcttttgtaatgcgactaccgataattgaagtatcacaatctattaatgtagaaggacgtccaaacttttcaccttttattgcaggcgaagcctccaaactttcatttaccattggtatcatattattcttatcttcattatcattgttactgtgattatttaggtcattttttgctacttcctcatttagttgca

SEQ ID NO: 15381 - DNA, 465 bp, Saccharomyces cerevisiae
atctatgtagatattttcagtcatataaacagatatgtaaccagatatgtaccagtatgcaggatgaaaattataaatgttccagctattcgaaaagggcctcgcatctcttagttagagccagcattttcagctttttttttctcgcgtttatttacatttcgatgcggctgtgagaaaaagttaaaaaatcgtggaaaccagcaactggtaactagcagtctgggccattgcagctaaaagccagacaaataaacaatcgaaaacacactcgaaacatgcattatgaaatgtcacatttttttttttcttttggggattaatggttgcgaagtgaggtcttttctatttactgcggtaagatgaataaaagttagggaatgttattgtttacaagctggatactagatctcaaaatgttaaagtgtaaggactgacaacaaaatatgctgcaccgaaaacaaa

SEQ ID NO: 15382 - DNA, 435 bp, Saccharomyces cerevisiae
gaatacgtgatagatgcttcgtgtatccaaaatccgtgtgaatatgtgctgtttagttttttccatccaatgaggatgggaaatatatacataaacgttatgtaatatatagaattcatgcaaaattaacaagggaaatatcaccttggttgtgtatatgggacgttgttcgacagaacggattgattttcaccagttccaattgatatgatcttttccaaatcaacttcctcattctcatttgcacaagatgactcgcttccgtctgcttgagcgtccttttgtatccatcttttgaacaagcttacaaagaaatttgccgtcatgacttgctcaacttgatataaaaccaagggaaccaacaacttacccaggtgttcttttttatcgccgtattgtgaagtaattagtgatacacccagtgctgcagtttta

SEQ ID NO: 15383 - DNA, 435 bp, Saccharomyces cerevisiae
aaatggagacaaaagaagggttaagatgcactgatcaaaaaaaaaaaaaaattctttctacttattatatatctctctcgatttctagtgtgtcatcgtaactatatattgtttcgagagattttattattgtaattaatttattgccattttgatctattctacatactaacaatcaattcatatcattatccctgtttgagtaatattcgagcctcatcataaaatctaataattcaattctcaagtttcttctttcttccacagatattccgttcaagtcgcccggtgtgaaccctctcaatctggccactaaccttctcgacttttttgaaaaaaagtgcacttttaatgaaggtgtggcttccctagatgtagcatcttcgttaccatctccccccaacaaaggttcgccatctgcttctgtgtgggctt

SEQ ID NO: 15384 - DNA, 475 bp, Saccharomyces cerevisiae
caaatacgcgagcccttgtctttccaatccaaataatccgtttttgttaatgatatgttatattttatctacttatacattttatctaaaacactttctatttggttaatgaccaacgaggaagtttgtagcttcaacacaactttagatcatgtaataaacggcatatgcttttaaatgctttgttttgtttttttctttttttcccgctgtgacagaaacaattaagttgcgttaaaaaggttccctgatagaaataaatacggctaaattaaataaactactacataatcctacaacatcaaatgcctgtagatcaagaaaaattagctaagctgcacaagttatcagcagcaaacaaagttggtggtaccagaaggaaaataaacaagaaaggtaatttatataataacaatgacaaggataataccaagttacaagctgaacttcataaactgcatccaatgaccattga

SEQ ID NO: 15385 - DNA, 400 bp, Saccharomyces cerevisiae
tggctaacaaatggaaatgaaatatgtatatagtgtagcagtatgcaactcttttaaatacacgattcgttattagattgattagagcacttattcacgcaaatttgacacgctttttgaacatccgtttttcacgattttttactgaaggatcatgaaagattgccacataagagaacacctccgttgcaccaacacttcatcacgataaaaaaactatcgagctatcgtactacggaacaactacataagtcaaaaatggccattgattactctaagtgggataaaattgaactatcagatgattctgatgtcgaggtgcatcctaatgtggacaagaaatcgttcattaaatggaaacaacagagtatccatgaacagcgattcaaaaggaaccaag

SEQ ID NO: 15386 - DNA, 413 bp, Saccharomyces cerevisiae
gacaacgactttattttcactttatttagttcgcttcttaatcttgtcaaaaacaagatattgtgtaatcgcctcaagtaaacaatatgtttttcatacgtgatttgaagtttttaagtatctgaaatacatacgcgcgcgtatgcatatgtattagttaaattactcgaatgtcctttatataatattacatttttacacacacattcttgaagaagaaatcccgatcgtaaaaaaaaacaccgtgctccaaatggccttcaatcttttcgaataatttattcgattgttcattctcatctctataatcattcgccgtacgttcaggatatgacgcatcaagcagcgaagctaaacctgttggaaataaagatctgtcatagtcatcgtcttcttcatcatcatcagcacca

SEQ ID NO: 15387 - DNA, 410 bp, Saccharomyces cerevisiae
tagataagagatatctaacgataaaattataaaaaaaattctttgattatttttcagattagtattatttgttctccgtgaagtcagtgtatcgaactgccaaaagttctccttatatacatgtgcgcgtataaccatcacttttcttcaatggttctcttgaaattggcaaaatgattaactaattccagttcagttgataatgtatcgtatctgtagttaattctaatatcaggaacatttgttctaaccacatcgttaccttcaacaccactcttgtcaaaatctttccctatccaatgttttttgatttgtgcttcccacccactttgcaacacggaatttcttgccaattcacacatatctacattagacaatttataaatttgtgctgcaactgagtattcttc

SEQ ID NO: 15388 - DNA, 403 bp, Saccharomyces cerevisiae
ttagataattgttggaattccgttgttagtaaaggctatataatatttgagaaatgggtgaattttgagataattgttgggggttccattgttgataaatgcttataatattatgtatacagaatatactgaaagttctcctcgaggacataggaatcctcaaagtggaatttatatttttacatactaatattacgattgttcctcattccgttttatatgtttcgttatcctattacattatcaatttttgtatttcagcttcctctaacctcgatgacagcttctcataagttatgtcatcatcttaacaacgtatatgataatatattgatagtataactattagttgatagaaaatagtggatttttattccaacattccgacacaacaaagtctttc

SEQ ID NO: 15389 - DNA, 411 bp, Saccharomyces cerevisiae
ggatttatgtgaaatgcttcttttttctattaccatatatagaaaataggtgtatactattagtttaatgtaataagcaggactatgacaaaccaaagagtgaaagtagccgtttccacgttttaacggcttgtgtacactttgacagtcaatcagcgtagtgacttcttttatcagcggaaacaaccatatccataaaagaaacgtgatggtcgttcccgtagtttattaagtaagatgacaaattatccttctttagtcaattgaaaacaaaacttcttaatctgtttccaatgttttaaagtcgctcatatgttcatgactacttttccatgagagggttctacgaaaagcatcatcttattttcgcaacgctgcgggtttaggcctttccgctggtctcttttctgt

SEQ ID NO: 15390 - DNA, 423 bp, Saccharomyces cerevisiae
gagaaaagaaaaagaggattcgatttaagcttcatatcgttcagactaataggtaactgacgatttttctcttcattaccaacttttcaccatatgttctaattcgtcggattttcgatgaagcgttttaggtactctataggtatttaggttataataatatattgtatttttagacaaccggaacctgtttaatttgaagagtcattgtattcttggctattctgtttaaagttttgcagtgtggagtccctgagaaacccccgagcaaaaaaaagaccccaaaaccccgtaaatattactactctacttgtgtgttatacattttcaggagtcaaaacgtactaacaaccttaagcttgcttaaagaggtgctatatatgtcgataagaagcagagtataagggtgcctgaaaatgtttg

SEQ ID NO: 15391 - DNA, 453 bp, Saccharomyces cerevisiae
accttcaaataaagatatagaagaccgtaaagtagtagtgggtttgaagcctaaataagtagttttgtacgtactattattttaagagaagaacatccatagaaaagaaaagaagaaaaagaaacgaaccagaagagggtagcagaatcagtcattcacgcacccggcctgcgctgcgtgcaccgactgcgtgcgtgcgtgattggtaatgcagtgaatcatgctttttcatgacgcctcctccccgcccctgagccttcggtggccgccgaagtcgggtattaatgggcgcccctttcctggtgtccgggaaccgcctgccgaaaaccaccctccgcaggtccgcggaaggtgggtgtggctgtccccgcgcaaatccgagatcgattccgcggcgggtcggtcattcttttcatttgcgcgctaatatgcgctgtgactggcggttagtca

SEQ ID NO: 15392 - DNA, 413 bp, Saccharomyces cerevisiae
ggtatgtattacctcgtcctcatactcagaacataataatgaacctctgtgctattcatattttgcgatacgcactaaaataatactatccagaggcgcggactataatactattaatttgatttttgtatgtacatactgaatgatatacttaatttacatagaaacatcattttaaaattcaacgttggaaggaggttgcgaaaactggttggctggtctgctgtacgagtcgttttggttctgataggcgccactatcattttggtagttatttctgttttggtagtttccacgttggccgcctcttcctctgtttcctctgtttcccctataatttccacgcccacgaccgaggcctctagagtgaaatcttggtctggcagaagcttgtccaaaggtgtcaacgttca

SEQ ID NO: 15393 - DNA, 442 bp, Saccharomyces cerevisiae
aacaaagacgcattctcctcctccttaactttcaagttttcattttcagtttttaaggtatctatataaatatatatatcttactatgcaaagttgttgatatttcactttaccctaccaaatggagttaattactccaaagtgatcccgaacgaagttccactcttgatccaatgtctcctttctatatcttcttctaatcatcggaacgttgtgctttatcgaggtatctttcgctgtatcgtaccaattatctatcccacccacgttctcctcaaagtaaggcgcctttttaactccaacgccaatccaatgagccttgtaccaaccttcatagccactagatagcacacttgttctcgacaactcgcacaaatctgttgggttcagcaagtaaatacttgctgctacactgtattcttcaatgagaggttctagcgtg

SEQ ID NO: 15394 - DNA, 401 bp, Saccharomyces cerevisiae
gtaaacaaaaatgtgacaaaagaacgaatatatatagatgtaaaacatatggacaagcaaaaagtcgaattatgtatgtcattttaggtactgaagaggtaagattttttttgagtttttcttcgaagatggttgtgtggttatatgttaatcttccttagcgcaaaacacttccatcaactgtatttcgttggaatgctttgtattcagttttgtatcattatctttaatcacaattgcgtcaggatgtaagaactacgtaatgatcttattatttctcgtagagaatagttccgtagattgaatacgctccgtcattatttttaaatgtggggaaggggtaattctcgaggatttttcaaaaacttaaaatgcgctggcaacatcttctttggtgaaaa

SEQ ID NO: 15395 - DNA, 478 bp, Saccharomyces cerevisiae
cacaaaaagattttcttataatgtatgtaacttttttttaagtagcccccagtagaaacactaattttactatactcatgcactagtttcaagaagatgagtaaacctccctcaaaaaaaaatggatcttaattatctaattgagatatcgcttctcgaggattattttaactatcctctatttatttgaaatgccaattacagttattatcgatcgaccgttttcgaaggatctcttttcttcttttaaaggtagaaaacattctctcaaccttctttatgcgatattcggagtttgcgccgtgcttcaaagatatggtaaaacaaaatcattgtggctaaagaaatgtctggtgaaaatatcaataacaaaagtcagcatacagtgattgtaaaagaaagggatttgtcttcgaaacatttcgaaatatggattctatcgttaatgttgttgaagacgatgttaagtacgcgcaga

SEQ ID NO: 15396 - DNA, 487 bp, Saccharomyces cerevisiae
aaaagtgctggctttgcaataattagaactttcagtgatatgcgtatgtatatatatgtacttgttgtggtatcctagttaatgggcatagaatgtatttcatcaaagcccaaaattcattttaaagccatttccgaatgggaagccacttcctggatttttgaacatgttattttgcctaggcccctgaggaaaagtgttgcggcgggggtttgatctggaaagatcgtattccttccttttatcgtcatcacttaatgtttcgtacgcttcattgatttgtgacatagtttcgtgaattgattcttgtttgtcgttatggttggcctttattttgtctgggtggtattttttggttaaatttaaatatgctttccttatttctttcgaactagcactaggcgatactccaagaattttataatagtccttttttgggtcgtagttaggcgctgctgggggtgcttgatgtcgttggtgttgttgc

SEQ ID NO: 15397 - DNA, 434 bp, Saccharomyces cerevisiae
tttggcctccaaatgtaaaaattgtacaattaaggacaatagtattttcattttataaaaaatatgtacatgttagaattttataagccgaaaaagcagtcattttaccagttgttttattcttatcagatgtcatattcatgaaaacataacactggcctacacattacactgattttgttctttaggacaagaagttttccagaaagagtttgctgtcattcaccaccagtatattatcatatacagtataaggagatgacatgagtcgtgagaagtagtcagcgaactttatgagagctcaaatacaaggattggtaaagcaatagtaagaattgagtaaaattattacacaacagttgggatttcgttgttgtgaaaggttataatattaggttttcaaaaatatattaaaagccaccctcgaagataca

SEQ ID NO: 15398 - DNA, 420 bp, Saccharomyces cerevisiae
tgtatcctacgtgtttgtatagtttggtacattattactagtgatatatacatagcacaattcggaaaaaaaaaaaaggtgcataactgcaaatggatcacatagaaatgaaaatagttataaaagttacatataattaatagacgtattacatacatgcttaaagtgacatgttaaagtttttttttttatctccttgtgaaaaaaaataacactgaggggaagaaaggcaactgcaaagaacagaaggggagattattctttttttttttttcattcttgaatacttttgcgggttctcttagaatagcatatccatggtgcagcatatacataatgcagccagacatgcagccagacaaccttcgttacccctctggggtggttgttgttggacgtagactggttgttgatggcctt

SEQ ID NO: 15399 - DNA, 411 bp, Saccharomyces cerevisiae
agtctcctccaacgtttttatgtagcgagtgaaggtaaaaaaattttcaacatttctaattttttcctgtcacccacttttattttaactgaattattatatttagctttacacatataagtctcaacgtctgacatatgtcacactttctttaccgccagaccacttctaatattccgaaagcaagggctatgagcagtccgacaattcggaaaccatagctcgccataatttacacgctctatgcacatattaaaatacatttaaacagtacttacagcgcatctgggatggttcggttatgtaccaggacaatattaagttgacgcgtcagttgagtagtaatcgtcctagtattttcgcctaccatgccgctttttgcgtttttgaccgcctctggtcccttataca

SEQ ID NO: 15400 - DNA, 400 bp, Saccharomyces cerevisiae
gattaagggaaaagatatacgtcagacttattgctcttttgtaaaacaataagatctataatatatatcacatctttcttttgaacatacatagcttcgttagcagtttttgattaatcataaatacttcaaatatcccttcgcattagactatactcgctggatgatattcggctatgtattttccaagcccattcaatcgtcatcaaagcgccctttgcttcttcgaaaactcgcgatgtaaacgcagcgcagaaaaatctacttttgaatataaaataaagtcaactcagatagttgttatgcatgttaattgtagcatctaaaaagcgatcgtaattaagccctaccgagatacaaaaaagcaattatcaagagatgtcgtttgtttccaagcttc

SEQ ID NO: 15401 - DNA, 406 bp, Saccharomyces cerevisiae
gcgaaatagaatgcataagcataagtgtacacgttgagtttattgttttatttcccctacatatatatacatatatatgaaattactttacgtacgtataagctttgttcagtcatcatgaaccagtgtcttttcgtactgttctaaggacattagaccctcgacctgttccacattaacgccctcaccaagcttcattttgactagccagccgtcacccataggatcttcgttcaccacacctggattttcctcaagattagtgttaatttcctctacggtaccatcggcaggctggtagatctcggaggctgacttgacggactcaatggaccctagcgactcaccttgggaaatctcagtgcccacttctggcaactcaacataggtagcgtcccctaaggaa

SEQ ID NO: 15402 - DNA, 490 bp, Saccharomyces cerevisiae
gttgttgtttaaataaaatttccaagaaaaattcttttaaatcattatgtaaccttttaaaatattaatataaacaatccaagtcaagtcaatgacatgagagtgcatatatacattgttggagaatatttcagtgaagcggttgcctttttctttgtgaacatcctagagtaaacataatacataagaatgatttttcctacaattacagaactatattcttcaaaacattactgtagagggtcataaagataggtttctttatttttttcctttgactcgagaatccatgctataagattgttaatcattaacgatgcatttcttctggaccatcgattagttgaacataattgcttggaataatacctgtttcaccgtttgcccttcttgccttccaccatctgccttcaatgtcagagacttgtaggatttcattttgttcaaatgagatttcgtaagcatcatcgtcatcagcgtcgtatgggta

SEQ ID NO: 15403 - DNA, 469 bp, Saccharomyces cerevisiae
ctcgtagaaagattttctccattatgatttttctcccattgcttcaataattctccggtacaaatagagtagcacaattatttataagaataacatacatacgcttaactctgccatataactatagtacattttctgtcctctgttcgcaaatttctttgtaaaacttaagtttatgtgctcttttttgagtttgcaatgccatctacaaaatcttcaattaaagaatcaacgtgccttaaaagtttctccttctttttgatggcctcaattttttcgtcttccacttcaactagctttttctgcaacatatcaatcttccttaattgctcttcagctgaaacgtcaacaccaggtaacgagtcaataagcttgtttatctgtcttgttttaagtataatgtccgtggatagctcatctatcgtgttagaaaattcctcaggaggtactactgtggcatgcttatcgg

SEQ ID NO: 15404 - DNA, 409 bp, Saccharomyces cerevisiae
aacatctaaatttgttgattgtataagtactctattaaacatcgttattttctcttttattactattaatattattatattttgagaatagaaaagactaatatatatatagtataatttttaaaattaattccgtacaaaaggcaaaagaaattgtcttcttacttaaaatgtctgcgaatctcgctgtaagcgcagtgaaacaatgttcccgcttagaagacgtgattcaagcggagtgaagctatgattgataataagtaacaatttagaaaaatttttgatgtttttagtaatgcaaaatatatatggtaggtatatgcatatatatgctcaatgtttattagattgaaatttcataaagtatattataacattattttgttggtctggcaaatcgcaaaatttt

SEQ ID NO: 15405 - DNA, 442 bp, Saccharomyces cerevisiae
tatagctgtgctgagcctgaagtataatgcatatccatcggactatttagacaaagcccaaggaagcctaaggcggcctgccaaggtgtttctccctttttttctccgatttctttgtataaactaaataatatagtgattactaatggaatggcggtattatgcacctaacctgttcattctgccacagattacgtaagcgatttattgccggcacttgttgtcttaatgaccgagtcaccaatgtggaacgataattttctctgactcaaacctgttaatttttttctacttcgtttcgttagcgacgacgtcaagccgcaggatcctgtctgccttgacctcttctctaccttcagaacttacacttttcaggtaagatgacctttatataaaagttgacactattacagttgtttataaacgtctgaagaatgagacg

SEQ ID NO: 15406 - DNA, 493 bp, Saccharomyces cerevisiae
aactattgagtccttcacaagtacaagtatacacgtatacatgtatgtatatatatgtatttaaatgatagaagtaatttctatatgtatatgtctattcaatttttatttctgatgactttgaaattttatatttattattctacactttattattaaaactacatgcaatcaatgccgttaaggttacgattcacctttttattacttattattaatattgttgtattacttccttgaaaaaatatgtctaaagagtcctaatttggattttcttttcctcctaacttcactgtcctgcgcctgctttcctaacgcatcatcgctaatacaccagctttcattgcttgttgctgcgctgttgctcgcatggaacgttttcagtgcgtcatcatcctgggataaactaaagactaagtcaccagtttcatttgaggcttttctctgcgcgttgacaaaagaggacagatcaaccatatcacctggttcaccc

SEQ ID NO: 15407 - DNA, 448 bp, Saccharomyces cerevisiae
tttaacttatataactgtacaatgtcagtcagacgcaactgatataaaagatgtgctctacaagtaaagattatttcaactcttaaaaatatttgaaaaatgcactataatttgatctaaataaggtacagataatggtaaggcaaaactactacatttggcagtgagtattgttagcttttccgcttattttctctcctggagtagccaccgttcgcgtcttccgagcaatggcgaatctcgaatctcggaagggcggctactgataacaggcactcatatatatattattagataagagttttttttgactgagtccttataacacgtaacttatcaagttgctatattgtaagttcaggtttccaatctgttcaaccactttatatctttaaacatgaaattctctaccatcttacctatactttgggcaaattgctgtctttgt

SEQ ID NO: 15408 - DNA, 432 bp, Saccharomyces cerevisiae
tgatattgttccctgtttcagccgcacagtatcacaaaaaatatacagtttaagctactgttttcgtcacgttccgaacagcagcatgctttgtatattttgtactaattcataaataagtaattatttctatacaaccgttatatagaagattttttcaaaatatagatatgtatatgtatacatatatcatcgtccaccacgccccttcctttttccctttccttggtgtttgctattaataaataatgtgcggagctcaatcgtcatacgttcacgccaggctccggaatcagagtaccaatgcatgggtacttattctcaaaatgctcttgccactcatccagtgcgtcaatctgttcttttgtcagatcatctaagggatcgataggctgatcccaatctttaataacgtccagatcgaaggagttc

SEQ ID NO: 15409 - DNA, 471 bp, Saccharomyces cerevisiae
gtacttggctcacgaatacatatcaagatacttatgatatatatatatagaaaaagcttacttttcttggagttattgttattatcatcgcgaagaacgattgtataacccggttcaacgcgaaacgaatcgttaaactggtgaaatgttaacgcgagtgtcagagatatacatagtatgagagtagctagatgttgaatcggtggtaagaacaagaaggaaataccgttaacaagtgaaggaacaatctagtattgttgaacaagaattatgagtaccgactttgatagaatttacttgaaccaatctaaatttagcggtagattccgtattgctgattctgggttagggtggaaaattagtaccagtggtggctctgcagcaaatcaggcaagaaaaccatttttattaccagccacagaattatctaccgtccaatggagtaggggctgcaggggttacgacttgaag

SEQ ID NO: 15410 - DNA, 498 bp, Saccharomyces cerevisiae
tgatactctgcccagtaaaacttagtataaagaaatatacatatatatacgtaattttaagggtcgcgtttgttatatgcttttacttcaggcatttcgcggtgatgtaggtattgagtttttttttaaaaaaattgacattgtttggcgaggttgaagatataaatgcctggattttaaaaagctcagttgctactcaaaccaaaatgtcaacaaatcaatttgcacaaaacaagtacgcataaactttgagagcatgagtgagaccaatggtggcaatgcagccagggaaaattctgaggtgaaacaaactgcagttgaaaatcctatcgataaactagatggaactcctaagagaccgagggaaaaagatcaggatgaacaagcggaagaaacgagtgacaaatcagaagcacccaataaaaatgatgaggagaaaaaggaggaaggtaaaaaagaccaagaaccatcgcataagaagatcaaggttgacgacgg

SEQ ID NO: 15411 - DNA, 412 bp, Saccharomyces cerevisiae
actaagcgtacgaagcaaatattacatactactatatacaagaaacaggctctaatagtttttttttcccttcaccttttcggttttagctttattataaaagatatgaacaaaacctccaagggtagtggtagcatggtatgtgaaattagagagttcatgcataacttgaaatgaaaataatactctgttacgtagctaactactgccaaatatgtatcgaaaatatcaattattaaggggtttcgtattaataaaatagagatcaaatacattcatattagcctaactattgtggcaattctttcaacttatcatccacgaatgtctgcaagatctctaatttttcgatttgttcaattaatgcacttaatgatatattgtccttgttacttccatcaccatccgttct

SEQ ID NO: 15412 - DNA, 441 bp, Saccharomyces cerevisiae
gttgaaaaggtcatccaatataccgccccctatatgtatgtacctttaccttttatttaagtactagtgctgtttagttaggttatgtgaaggcacgggttttgtctttttttttttttttttttactattactttctttttcaagcttttaagcgccgaaatgatatttaagggaagatgactaaagggacagcgacgaggattcagcctggacagtgatagaaaagttatgcgggaatacgtatatatagttgtataaattgtggttatagaacatcgcagcgcctttaaatatattgtcttttatttcaatcttattccatctctctcttgcaaccacggcaaagctggagctatgtctgaaaaatcagctagcaataacaaagctgaattcaaaaggcagtcatcgccattcagagaaatcatctctgcggatcacc

SEQ ID NO: 15413 - DNA, 401 bp, Saccharomyces cerevisiae
aaaatataaactcttttctttcgatgggtcagtgctacagaatgtgaacctcatcgatgaataactacattatgttacttccgaatatactggccattttgaggaatccacaaaaggaaatggatacttatacatagtagtattattatttcttctttcgtttttatatgttgtcaagtgatcattaataataacatgagttgttatggtaacaatttaaatgtttacatagtatattgaggtacacccggtatacgtttatgtgtaaatgcactaatcacaggataaaaacttaagcgagcaattcagacaatgctgagctgagttaaagatatattgattgaacataatgtggtagctacttatatatatgaggaatacgggtcaccacactaaataca

SEQ ID NO: 15414 - DNA, 498 bp, Saccharomyces cerevisiae
aactaatcgccagtgccacgtctctgccttcgaccggacctttttaagtacgataaatatccttttataaatatatagtctaaaatatccattaatactgtgctcaatcaatcgtgttagatgatttagttttttccaaatcgttattatagtgcagaagtagtatacataaaggcatatgcatgcgatttggaagtaacgctcgccgtagacaagtaagaatgcctgctgtcttgagaaccaggtccaaagaatcctctatagagcagaagcctgcttccagaactagaacgagatcaagaaggggcaagcgtggtcgtgacgatgatgatgatgacgacgatgaggaaagcgatgatgcatacgatgaagtaggtaatgactatgacgagtatgcttcaagagcgaagctggccaccaataggcccttcgaaatagtcgcgggactgcctgctagtgtggagctgcccaactataactcttcgcttactcatccgc

SEQ ID NO: 15415 - DNA, 412 bp, Saccharomyces cerevisiae
ttcctgagataaacgcaaacacttttttactcggaaattttctctccccgattgtaaatttatttctcgtctactataataattcaccaaaaaacagcagagcacgtcctatatatatatatatatatatatatatatatacatatatatatacgaatatatttatgacagtctaaatcgttgctcctgttcaattttaacgctcttttataactgctgtggcgccatttctttggcatctaagatgtgtctcgggactttctttttctggtcatcttgctttccttgccttgtcattaacagagctaaactgtgttgaggaagtggtcttttaaattttcaaggtcgcggcccgtgcattgcgcggctggatgtcttttaggggagcgatgcgcttgcacaaaagaatagc

SEQ ID NO: 15416 - DNA, 482 bp, Saccharomyces cerevisiae
tgggaaagaaacgaacgcgcttaggcgaatagtttttctttataataaaaatcatgcatgctacatagacattgaaatgtgaattataagtacttgccagaccttacatactgatttatacaatttatggagaagaaaactgaatgggccacctcgccaaaaggttagtttttgattcagacaggaatcaatactggtagtacattaaacaatcaaggccgcctttatagttgcgcttatgcaacataatcatctgcaatctgcaatcttagtttcactgcctgtggaataattttttccgttaactgctttggagtattctcgcaataaaggttcataccatacacttaacttttcttcacctttgtccagtaaatttctcaaggcagaattcctataatgcacagtctcaagatctataatagcacctgcgctcccatcacctatcaagctgcccatcacctttggcatctcattgagca

SEQ ID NO: 15417 - DNA, 436 bp, Saccharomyces cerevisiae
ttcacttatcagtttacttcatttcgcgaaaaagcctttaattattagtgatttatttactacatgatattaatatatgtgtataattatgcaataaggcctctcagaaaatatatgtgttacttctcgttgtgccatctgtactaggctgagtaattgtgtatttcatatacttgttaggaggatttgctcgctcggaggataaatacagagcgttaatagtgcgtatcatatgttttataatatctcaggaatgaaaagttcgtagagcagaacaatatatttcattggtgcaagcatgtggctttcaaagttccagttcccctcgaggtccatctttaagggtgtttttttgggtcacaagttgccgttactagtgcgactgacatcaacaacgactaactctaagagcaacggcagcatcccaacacaatac

SEQ ID NO: 15418 - DNA, 403 bp, Saccharomyces cerevisiae
tatatgttttcatatcctttataattctttataaatggctcacataaatacataagagtacctgattgtgtttatttatattttttgccaaactaagtactgcaatagattttatatatggtttagtttttaacgacttgaatcttattgtcttttttccatttttcaaactcttttgcagtttgtattaaggtttctttcattttacttattgtaccttctatgttttccttcttagtttcaagaataggcaaactcgtttgaacatcactttcaacaagtgcgccacctatcatcctgtaacattttctcgtcggctcagcgtctttcagtgtttttatgactatagtgtgttcatctttgtcatgacctaattctatgatttttgtttgcaattcttcca

SEQ ID NO: 15419 - DNA, 500 bp, Saccharomyces cerevisiae
ctgtaataaagatataaagggctgaagccgtcggtgaatttatcccatggttctacagagaacataaactatatactatttacataattaattcttagacgtataggaagaaggcagttcttcctaactcaagaactgcgttattcaatgtatgaatacgctatcttttagctataaatctccattaaaaatttgtatgcaatatgtgccacaatccttcctcatcttttttttgagacttttaacccaaacataaaatacccccatacatccagaatagcgtttttatgtctcaaatagttaacttttttcagcgcgcgcagagcaggaaacaaattaagctcacttcggtgtggtaccagcccaggaataccgcttctcaataagcgttcccctctaaaccctgctgcaatttactaagtgcattgaggcagaatccagcgcacatttgatgctcttagcccaactctaagccgggcgcctgcttgttccctcctgta

SEQ ID NO: 15420 - DNA, 438 bp, Saccharomyces cerevisiae
aacttcatttaatttcccgtatatattatatgtacgtatatatgctataaacagacactctttttacttacctttaataatgcttgatgagaaatcagtcattgttacttcttccccaaggttgtcatcataatcataccattcattatcctctagttggcatgacattactttccccgaacttagagaaacttcaaacgttatggtgtcgggataaaatttgattaattcacaacctctgcaatcaaggcttaaaggaatgaaagaatcttctttgaccttcgataaaccatgcttcttccgcacatcttttatcttggcccatttgtcgtcactctgatcagttaaatattcatcctcaaaagcgcacaggttaactgacaattcttttgaacaaaatttacacttcatcaagaaagatgcggtaccttttgatgc

SEQ ID NO: 15421 - DNA, 495 bp, Saccharomyces cerevisiae
cgtgttcaggtatctttttctcgttcagccgtggaacttaattcaaaattgaaaattgtatacagagtatatatgcatataattgaaagcagcttactacgaaatgttcttgaattgctggccgagttgcaaatcagctgcaaaggacagaaccctatgtctgaacatgattgctttcgtaccctgaaagccagcgctactaattaaccaggttgaccagccttcactcattcgcggcgacagcaaaagcggaagaagaaaaaaataaccagcaaactgtcaatgggtttctaggaggaaaaagaacaagttaaaaatgattagcaccaacaacgttgcctatatctgtcattgggcagctgtgcggggattctaaggtttttgcgcagatcgtgatataaaatgttgtaaaaatggtttgctactctatattgatgaagttttcatattcaaaaggatttattaaatgaatgaaccatttataattgtgagggc

SEQ ID NO: 15422 - DNA, 498 bp, Saccharomyces cerevisiae
tgcggatggtacgtatgttctaaatgcagcattatcagacaataaatgatattatatttttcattcactttctcgtttttgaattgttcctttgtttatttgtttacttttaaataattttttacatttttatcataagataaattgagagaaacaatacagaaatttggccatgggtttatctttctgtaaacatgttatagttcaggtatgatgtctttaaagaaacttctatgtgagctgttatgccttggccttgtacaagttgctttgtatagaatttttccgtaggtataattttcagagtaggttaagatattgtgatctttcttcgttaaactcatagaattaaaatcatggaatggatcagcctcatcaatttcatcatcgtttgcaactttctcacagaacattttggtttcctgttcactcactgagttccttttcgggtgtttattgcaagacaatataaaaggaagttcgcagccgttatcattt

SEQ ID NO: 15423 - DNA, 462 bp, Saccharomyces cerevisiae
cctcatatagaaatacacagcaaaagtatatagtaaaatatatatcaactggttcttcatgaaactttcttttccagccgcacatccgtagggcttctgtcgcttcatgtcgggtaataatgatgcttagggcttagcgccaaaataattagggtgtatgaggcggctcctgactagggtcagacggcattttttcgtctttttttatccggtttttcgtcagtggccatccttaatgcgcggcaaaggtgctgaaggcgccttattgtgttaaaaaagccaatgaaataaaagtgggatggtgagaacgccaaacgagtgaaacagagaatggaaactcgcttcttcacaagtatttgatggctagttttctcaattacttgtttctttggatagacacgaacatacagaacactttcaacaagacataattatagaatgctgctggacgtgaacacaaat

SEQ ID NO: 15424 - DNA, 423 bp, Saccharomyces cerevisiae
gagtatagtgtataaagatcagtataatttatagcctgggtcggtcctttaagcgatttcttcttattaaccttgtcagccgtttccacgtgacgggaaaagtgtccgatattgaaatagatgaaaaatttttttgttttaatattaggcgatgggcagaggtagcttacaattgcacgtagagactagtatatctatttgtatatcccagttcctgcaaaaactttatatagttaacgttccataatcatggtggaatgtatcactcccgaagccatttttataggtgctaacaagcaaactcaggttagcgatatacacaaagttaaaaaaatcgtcgcatttggcgcaggtaaaactattgcattatgggaccccattgaaccaaataataaaggtgtttatgcaactttgaaaggccac

SEQ ID NO: 15425 - DNA, 494 bp, Saccharomyces cerevisiae
taatcccaacgcacttcgcaagagtggtcataaccgtattcatatatttatatacatatgtatacatacatatatagatatatatatgtatatacatgtaagtgtgtaagctgaaatatatgttaaagcgcatgtaactaagacgacaataataataataataatgataataatagcctagattttctccgccgtgggggatgatcgtattctttcggatttaataatatagcagcaagggttataaaaggaaagataacggaatgtatcggtaatcattaaccatcactcactctccagaaccgtagcgtaattatgtctgaatcatctatttcttcttctaaaccatctgtggaattgccacaagcaacctggtcgcatctgcaaagatacccagctttatccaagtttattaaatatgcggaatctctgccacctgtggagagattgatttccttcaacctcgttgttttgggatctgtgaaccagtgggt

SEQ ID NO: 15426 - DNA, 451 bp, Saccharomyces cerevisiae
taacgatttttgttacagttagcctaatgttcacactacgaatatatatatatatttatatatgccatacaccttacatttacagctcagtgtataaccttgtggaagcgcgaaaataagcaagagacatttgaaaataatcaataaacaaagctcaaaaaaattagatcatcacctaacaaaataagacgtggcaattacagaatgggggaaagcttggatagatgtatagatgatattaatagggcggtggactctatgtccacactctatttcaagccaccaggaatttttcataatgccatcctacagggagcaagcaacaaggcaagcattagaaaagacattactagactaataaaggactgtaaccacgacgaggcgtatcttctgttcaaagtcaaccctgagaaacaatccgtttcacgtagagacggcaaggagggagtat

SEQ ID NO: 15427 - DNA, 489 bp, Saccharomyces cerevisiae
taagtagattgattacccctttgttataaataagtatatgtgtttactatcatataataattaattagttgtaagtatggtatttttcaaagaaacatttagtattatttttaaagggtgcctttaccataaaaccaaaaaaaaatggcttctgagagaaaaacataaataattgataaaactgaaactcacaacaccaactcttccgctctaaacacccaaagctcaaaaaacgacatgtgcacatctatatccataaactttcaaaaaagtggttcattcgcaaattcatgaagtattatttaatacacagtaatctggcatttcatactatcattgctcaaattatccgccggacccttgaaactgtggcgctttttaagacgcatctccaaaaaaagaaaaagaacaaaagaaaaaaagctgcaaatatatatacaaaacagatttcacgtttattgcttgggagtaaggtaacgatccggaagc

SEQ ID NO: 15428 - DNA, 400 bp, Saccharomyces cerevisiae
cgaagatacactacttttatttttaatttattttctttttttgttcgtaaatttatgtatgcatgtgcttaactaaaataaaaagagaatgcttattttgataaaagggatgatgatataaactacaataaggtttcacccaatgcacaccttgcaatggcgcaacctgcagagatggtgtttgaaacatggatatcatgaatagccagatcagggttacattcaacaacgtctagcgcaattaaattaccggattcggccaatctttccaccaagaaaagaccttctctcaaggtcaacccacctctcactggagtacctgtagcaggaatgtataatgggtctacaccatcgacgtcataggagcacataatgggaccttcaccgtttgtttctgggt

SEQ ID NO: 15429 - DNA, 445 bp, Saccharomyces cerevisiae
gaaaaaactgttgttgtttttatgtagaataatgtactgatatacttgaaataaatttggttttgccaacagctttcgcaaatttctgtcaccttcttctttatgtaaaacgacattacttgctaaaaaaaaaaatacttctatgataatgtgtacttgtatgaaacttctataaatttaaattggtgaattttatccagctatcccccaatttactatttgaatatatgcaattgtgatctgtcttaagaccttttcaaaccattctggcggaagcatcggtggccatttccgtatacgaataaccgtcttcattatccttgatagctgagtataaactattggaaatgggttcattacgattttgcgcatgttgcccgtcctcgcgatcaaacgaggcaggaacgggctgcgtatgggtcctgcgcagagatagcctttcacc

SEQ ID NO: 15430 - DNA, 402 bp, Saccharomyces cerevisiae
acgccgaatttacaactcgaaactttgctttgtcaaagatatgtacgtaagcatatatatccggattgtataatattcataaaatagtaaagtatattttctttgcgcggtgttataatttgctcttttgcatttttccgtttttttcttacctttttatccccgacaatggtaatagtggtatattatataaagaggaaaggcctcgaggataatagaaggcaatgcaccatcaattgctttacccctggtccgcgacaaatggtgacagtcggtgtgttttctgagagggctagtttgacccatcaattgggggaattcatcgtcaagaaacaagatgaggcgctgcaaaagaagtcagactttaaagtttccgttagcggtggctctttgatcgatgct

SEQ ID NO: 15431 - DNA, 441 bp, Saccharomyces cerevisiae
gtctgctgctagttttcctctaatagattaatataagattgtataatttgtaataggccaggaatggcattgtctcctgcactcggtgagcgaaccatattttcaaattctgctagttccgaggtcttttcctgaatagcatcatccagaatctgcaaacgctgttgcaacaggtcattaatcttgtacagcgcgtcgatcagtgtctcgaggctaagggagtgtgatagttgctcgctttccagaaatcgcagtaatctagagcgcaacgttatgaaaaactgcttgattcgtgcttctaactcagaggtcactcgcgcatccctggcctgaagcaattcgtaccaatgttgcagttgttgctcgtcgctcgtgtacgactgtagttgctgcttgaactcttgaaaacttatcagagtagtgagtagcgaatccgaaaca

SEQ ID NO: 15432 - DNA, 403 bp, Saccharomyces cerevisiae
ttttagaataatactccataccacacacacacatatatatgtatgtatgtatgtatgtatgtatatgtatatttgccaaatccttgctcaactcttttcctgtgattatatgattactccctagttgtttcgttgttagccgccgaaagtcatcgcccgtaatttccatggcttacccgacatcggttagaggaagtttttgacgtggaagagggaaagaaagaaaaaacagatgtggaaaactagaatcccttttaagaacaatagcacggacccttcctacagataagaggacactgacggctgtgtgttaattattttcgtattaagcataaaattggacagtggcattcttttcttcacccttcacgttttttatacgtctcatacagttgggccattt

SEQ ID NO: 15433 - DNA, 401 bp, Saccharomyces cerevisiae
catagatgtataactagaacaatttaccacatatacataactatttcttatgtttattttcctaaaatcctttatccaactacaatctactaaggcttaagctattttccttttcattatttaataactgttctttcagtttacagctccatttatatccggttaattttctattgctaccaacgattctatggcaaggtactaacaatgccaggttatttgagccgcaagctcttccgacagatcttgcggcagttggcttccctattctctttgcaatatcaccatatgttacgacgtggccgtgttccacgtttaaaagctcattccaaactttacgttgaaaatctgttccaaacaggaactcaaagggaatagcgcccgatggtaatggcattttg

SEQ ID NO: 15434 - DNA, 464 bp, Saccharomyces cerevisiae
tgagattcttttgcgaatatagttctttaaatttttactatatatgcccacttatgtttggctctattaaatggctacgtgtttatatagtaccgtttatgacgctgtatttttatttacactgctttccaggagattaaagagcggagtgttagtcaactctcacgacaacaacagttatatcgtcttctttaccaccgctgtagtttttgccagttagcttagaaatctcttgcgcaaaaacactggggtaattggggtccttgcttaaactgacaacattgtccacaaacttctgggataatagctgtaactcatcgtttgttctcgcagcgttatccttcagaaaaagctcaatatcatctgtggcaatattatcggttacaccatcggtagccaatataataatatccttttttttcaattggaagctatattcatcagcgtctctgggggtgtttaaa

SEQ ID NO: 15435 - DNA, 479 bp, Saccharomyces cerevisiae
gggcaatattttccacataaacttgttagtatatttagttaaactctataattataattgttattagtttttgtattatttgatgggcattacccgaccgacttgtcatgaagtgaaagaaaagctcatcacaatatttttaaacagaatttaagatgcattagctggcaaactacgtttcaaatatacagctcagctagcccaaattctctctgcactctcaataacatagctttttaaaatggcagaccttcaaaaacaagagaatagtagcaggttcaccaatgtttctgttatcgcgcccgaatcacagggacaacatgaacaacaaaaacagcaggagcagctggagcagcaaaagcagccaacgggactgttaaaaggtttaaacgggtttccgagtgcaccacaaccgctgttcatggaagatccgccttctactgtctcgggagaactgaatgataatccagcgtggttca

SEQ ID NO: 15436 - DNA, 433 bp, Saccharomyces cerevisiae
aagatgaatacaatcaataaaaaggtgaaagaaatcaattaacaagaaacgggttatgtattttatgtatgatatcctggcattgtcatgtataggtcaccttcttggggaatttcccattttcaagttattctgcctctaatgcgataaccgtaatcttaaattgtttaatttctttttcacaatctgagccacgcccgaaaaaaaaacaatgtaatccgcgtaaagcgaaactgagtataacccaaaaatagaatgtaaattaatgaaaagcccatttctccaaaagatcagctttactcaaatatctaattaagtaattgactgtgtacattgtcctttatctcattttgaatcacctttattaatttttggttgttatataggacgaacaaattagaacgaaatcatatccagaacgcagatatgatcg

SEQ ID NO: 15437 - DNA, 459 bp, Saccharomyces cerevisiae
ttcttcctggcggtagtatgtaagtaatcgtaagtcgctcatataaattgtagttgtatatctatagtacgaaaaattcattaccctctgtggatattggcggaatgcgaaacacgtcgcctttttttcctcgcaacattttttttatttttttttcgttttgaaatgaaagaatactagtgattaaattaaacaaggaaaatagtacagattggcgtgtattgtccataactcgtgtccattgtccgcactacgctagtttaccaaagataaaatcacgtataacattgaaaaataaaatggctagagctagtgaaaaaggtgaagagaaaaagcagagcaacaaccaggttgaaaagctggttgaagcacctgtagaatttgtcagagaaggtactcaattcttggccaagtgtaagaaacctgatttgaaggaatacaccaagattgtcaaggctg

SEQ ID NO: 15438 - DNA, 482 bp, Saccharomyces cerevisiae
gtaagaacagtagcgcagaaattcaccattctctttttttttatattttatcttcttcgtaattctatcgatggaccaatacaaagatgattatgactagcaagtcattattatgatcgttatattatacatattatgtttacgcaactaatttttatatcgaattttatctgaaaaaaagttttcaaaaccaacaaaatattttgtacactcttcgaaactcaaattctgcaccatttccattctgataaaaggtttaatatttcgaagcttctcaactacagctcgtgttcttcttgcagcacatcagctgctttgctgcactgttcagggtaacgttattcattacaacgagaatatttaggaattttgctcaaattcatggagcttcctacatcattgcacaacagaatttcgttttgtagtatagtttattagaaacaaatgtgaatagatcatgagacgcgaagccctattttagc

SEQ ID NO: 15439 - DNA, 431 bp, Saccharomyces cerevisiae
ttgtatattagcgaggccgtgtcacgttcccttttttggtctttatatatgtgtatcttgttataattttaaagaaaagttttatattactcatcagttgtgtgtgaaaaatatgggcgggtattcacaataggaaaaaaaaaatgggtttggtgactgcagtaaagacgtgctaaaaaaaaaaaagttgtttttatctgaaccttaaatatatcatttatgagtgtatatattatacaaacgcaataacagtggctcccgccctccacctccgcctgctactagtaatctaccagtaattgtgtttgttttgggaaagatcgttcgcttactcaccgaacaactttctgactctcttcaatacagagtccttttcagggtcgtagggatgatctttagatggaatttctaaaatagcagggaacgcattg

SEQ ID NO: 15440 - DNA, 492 bp, Saccharomyces cerevisiae
ttcagagacgtctttcttgtatctagtagatgataggaattaagtattttttttttacctaactaggattataattgcaacaacaaaagcgcccttcgtgaaacacgtgggataccggttaggtaatattacagtttccttacacacttactaaatacgcaacagagcatgttattaatcgtatatttaagtaataataacgtattgaccattcctaagactgaagcagtaccaagaaatggcactttttgtttatatgacatagtaaaagtgttcatttggcagaaaacaagggtatctggatactgcaatcctcattagttgcggagagcttttttaaagttttattacttcgataatgctttcctccagaactgggcgcgcactgaagccataaactgagtggttgtccctgtgtatattctacaatcgcctatttgaaacttctgggtgataatatcgatttagcgattgggtttctcccttctgaga

SEQ ID NO: 15441 - DNA, 473 bp, Saccharomyces cerevisiae
gcaaattaagggcagacaaagttttttccatgcacacaggtttataatgagcttatatatatgtatatgtatatgtatacaagcatgtgtttgtatttacaggaaaaaaatcgatgaatatatttagtgtgtcggaagagtgcttgtgaaggcgtctttagcagttccgaaatacgttaacccaccgaattccgtttggcagactctttccttcctactgctcttgacgcccttgcggtacgtccgatttttgactgcctcctcgatggagatggcatacgacatgggcaccactttaggctctcgtacgtctcgttctccccaaacttttacttggcccattactttaagaacatcgtccatgccgcttattttcctgaaattaacatcgcaaaacttcatgaacaaatgcagggtatagtaggcatcgttaccggcattgtgtagaaacgcatgcggtatctcgaacaacc

SEQ ID NO: 15442 - DNA, 489 bp, Saccharomyces cerevisiae
gtaaagcaggaaaatgtagttcatatctatttacttttgcctacatacgattacatacacgattggataacctgaagtcgcgaataattctcggtttcatactttttaccttgatccttccactgtttttcccctgtgccaattacatgtaaataaatatatacatatatatggtccaggcgcgccataaaacaaatacaggttgtagcgaatcaaaaaatgggaaatacatacgaaaaacttgaaagaaacaagtaccacaggacatgctgtggtccgtttttccccagagcacttttatgtgggactcttagaagggaaatagctctgttcatatagaacaaaaaaagaatagccctgtagggggctcgaacccctaaccttatgattaagagtcatacgcgctaccgattgcgccaacaaggctaattcgttggaaaacgtccccatttcagggaaacatagctcacgatgttaataactgatttg

SEQ ID NO: 15443 - DNA, 405 bp, Saccharomyces cerevisiae
accggattaatacaagtaaaatcagcaaagatatagaagacaaaataagcgtgaaaacaatcataaaccactcacaacgggggttttcagctgttactcctccatacatacattttgataaagatataatgttatatttcttttcgtaattttgttttacttcggtttgctctatagatttcatcagccgcaccgaaaagggagatcaataaggtaccctttaaaagggataagaagcctacatcaccccaataaatggagtaatggccagcattggatgaagagaagaattacgggatactgggataacactgttaaaaaatgcttcgcgacgtgagggtcttcttcatataaattgaactgccaaatctctttcacattatccaggatagtttggaatgtgtg

SEQ ID NO: 15444 - DNA, 493 bp, Saccharomyces cerevisiae
actataatagcgtgtcattatttattacgcggaattctaattaaatagaaatatctaacttttattttttttcatcctatctcatttcttgtttctccctgtcgttgctaaaatacgaggatctgcatatgtttacatatcaacgttcccgtaaacgaatggagaatactgagtgtcacgttaataatacggatattataatttggaaacctagtcaagtaaaaccagaagagatttttcttttctcttaagcttttttggcttgaccaaacgaaaagtccctcacacccaaacactgaaagtaattcttcgtatttaaataattcaaaagttatgatgagcaggctctatgtaaaaaaatggcccataattttccctagaacgttataaaaacgcgactagtgaggtattgagtatggagagtatatttggtgggtttggagatctagttgttcctaggccaaaggagcatctcggtcaaacagacctttcc

SEQ ID NO: 15445 - DNA, 468 bp, Saccharomyces cerevisiae
cgagaaaagcgtgtatccgcatactataaatacgtatatataacaaagtaaccatcaagaaagatgttccatacctcaggtcatcaccatttcatgggtcgcttaaccgaaaatatcagaagcaacctctaacggcgatggttttaaagatggattacctcagcaccaacagttacactattcggaaccgaagatttatctacgatactcattatcctttctctatctcaccctgaaataatttattaaaaataaactatgccaaagaagagaaaagagaaaaatttaaaaaaaacgagagccattgcaacagttttggaagtaagaataggttgaaaattagtcaaaaagacaaatccggctcctataaaccatcaaacaataggctccctaaagcatcacaaattgttatgctttcttttaagagaaatgttttttaaagcatcaaaggtccagggcaagaaaaat

SEQ ID NO: 15446 - DNA, 432 bp, Saccharomyces cerevisiae
gaatatcgaagcatcacgtttcataacgcaaaaaggagtcaaacaaaaaatgaagtatgaagtcaagaaaacgaagaaaagaggaaaatagaagaaatgaaaatattattttacaagcgtaaataaaaattttataattcataatgtcgaaaaatgtatactgtgttaagacgcctttctttgctttttctcttagtctttattgcatagttcacttagcctttccgatgctagcggcttttcgcatcgttcggaaattagtacctttctttttgccctacaagaaaaactattatacagtgtaaatacaagataacagagaccgctactcagacagcaacttctaacgtttcatcgagactagtttcctttcatatcattttatagcaataaccattttccaagtgcaaatcatgcctctatcaaaggtgg

SEQ ID NO: 15447 - DNA, 493 bp, Saccharomyces cerevisiae
aaatacaggtgaatgaaatatgtatacatatcttgattaactatgtaaggttctcctcttgcttttctaccatctatatagtgcggcggaaaatggaaaaatgcggttaagtacctttaatgcatgcacaatatatgcaaattttatgcagttcaaacaggacgacaagcagagacataacgacactatttttccgctaaaatgaatgaagacctgcccaaggaatattttgaactaataaggaaggctcttaacgagaaagaggcagaaaaagcgcccctgagtagaagaagaagagtcagaaggaagaaccagcccctaccagatgccaagaagaagtttaaaacagggttgaatgaattgccacgagaaagcgttgttactgtaaacttagattcttcagatgatggcgtcgttacggtaccgacggatgatagtgtagaggaaatccagtcatctgaagaagattatgattcggaggaatttgaagacg

SEQ ID NO: 15448 - DNA, 427 bp, Saccharomyces cerevisiae
gatttgtaaaaccgtatatatctttacataagtacgatatggtataactgtaacattgaaggactgaaggactgaaggactgaaggactatagtcaagggccaatggggaaggtcccttccaggccatttgcccgatagtttgtccttctcttgcttttccgacggcccgattgcatgtggcggggcagcactggataaaaaaacgtggggggagtgattaaatttatacgcttattgtgtcaacacggaaaccttatagttatcattactaacatcgcaacaagctgcttttttactcgtttttagccacaccataccccctttaattaactaataatgcataaaatagttattgcttcttgagttgcagcttcttcctggacgtactgttatatatggcatgtcttcgcatgtccgtcaaattta

SEQ ID NO: 15449 - DNA, 477 bp, Saccharomyces cerevisiae
tgatcacaaccattacatacatcatatatacgcatgtgtagggtcttccttcaacttgcaaatcaatgttttatctatcattctgtgctatagggacctcgcaattttgacacttccgtaaggagtcattcagcggcggagtcactttcgctaactctttcttctatatatacagaccaacaaacaagtatctaatgggaaagggaatctccacatgaagcataccacatcgacaatgttacgcactactagactatggaccacccgcatgcccgctgtgagcaaattgtttttgagaaacagctccggcaatgccctaaacaagaataaactaccatttttgtactcatcccaaggacctcaagccgtgaggtacacttcccaacatgagtggatagctgtgcatcaggacaagactgcctttgtcggaattacaaaatacgccactgattccttaggggacgctacctatgttga

SEQ ID NO: 15450 - DNA, 453 bp, Saccharomyces cerevisiae
acataagcttcgctctgtcttttactttacgaataccgactacagacggaagcgggaccctcaccctgaggtacaacaaatacacagatacatatatatttaacaatgtacgttagccgcaatataagtgagattgtgtaggtgaaagattatggagatatacataaatattacagaaggtctaccacatgtgttttgaatattggcttgtgctaaggtaacactgttattttattcattagagaaacatctcttaccctgtttggttttggtataatctccaattacgtacatgaaagatggctttatataaaaagcctttaattcgaaaaaagaataaatgtcttagggagcttattatcgtactttaattcaacttaggaaatcagcactctccactccaaatcttcggtttgaaataatggaaaatcaaggtggagattacagcccaaa

SEQ ID NO: 15451 - DNA, 497 bp, Saccharomyces cerevisiae
caatagtggactgaaataagcctttaatgcaatacatgttatgtagatacaaatatagctctatctaggatgagtgttaccaggaattttatttttactttgagatcacttgcgaaatacttaaatagggactgtagtttactttttctttttttcaggtaaattcgtcgattttcggagaagactagaaaatataatgtgatgagaaactacataaaaaaatttttactagtaaatgtctatttgaaatactttatcgaaaagctttttatgtaaatctgtatagaacttctcgcgtaagacagttgagtaagcagtaacaatgggaaaaggtaaaaataagatgcacgaacccaaaaatggaagaccacagagaggcgctaatgggcacagttccaggcaaaaccataggcgcatggaaatgaagtacgataattcagaaaaaatgaagtttcctgttaaactggctatgtgggattttgatcattgcgatccaa

SEQ ID NO: 15452 - DNA, 416 bp, Saccharomyces cerevisiae
gaaactgatggtaaatagtgagtgcttccagattatgtaaactacgtatacttcatacacatatctagatgctagattgttagtctgttttagtcttttttttccctaggaacttttcctttagctttagcaatttgtattttaagccagattgcaacgtaatcttatcggcctcttcgacggtgaccattctcttcaccatcaaattgtatagcataccgaatatgagtcccatgattgtagatgttagaatgatgacgttatacggcatactaaaatccggtgtagacagggataacaatagggtagaggttctcatttcataaagagacgatgaggactccaaagatagcacggtgattacagctgcatcgatttcaaaaccatggtttgcatctggtggatactcggcaaat

SEQ ID NO: 15453 - DNA, 441 bp, Saccharomyces cerevisiae
actccgaaactttttcatattgataaatagaacagttaataaaacttatctagaaagacgtttgtttataaaataatgtatagtatcggtactaaatattaacttttccgaaaaatcaaaacatcaaagtattcaaaaagtgcttgaagaatattgattagagataaaaattcgtatgcaaggtgttaaaaattgtgtagaagtagtatataattctaaaggaaataatttcaacttttcaaagagagctttcctctaactctctccatagccatttcctccaaatatccccagccatatttaaaagatcatcaaaacaatgggaagccttagcatcattaccgacttcgattaacatgtgataattcgagatatgggcactcgaattggaactggattgtaatgacgccattgtagaagtagtcggtgaagaaggcaaac

SEQ ID NO: 15454 - DNA, 422 bp, Saccharomyces cerevisiae
tctagacacagatatgtctcgcaaaatgatgagtagttatttgtttctatgtataacgttgttatatacaagaaagaaaaaaatcatttctttgattcttgacgttgagatagacggtatctataatatgcaaaaaaggaggccagcaatgctgagagtgaaataaggaatctctttgaattagtgaaagacttttgaggaatcttcgtatcctctaagagtggattgctactttgaaaaactacaattttattattatcgtataagttccccacacatttccaaccttttaattcgatctcattaatttcgttcaaaactctatctggtggggacccagatgcattaataacgccaaataagtccgtaaaattgatgttaaagacactgtgatcaaagttgtttgacagggtcatatcctt

SEQ ID NO: 15455 - DNA, 491 bp, Saccharomyces cerevisiae
tagttcaaatatatacatacatacacatatgtacacttgaatgaataaaaagtatacatattaacaactaggcctgctttcttttcttttctttttttttttttttaccacacttagtcctctactttaacagaaatatcattttccagtttgaccatagtttcttcaactgttttctcctcgtgtttaacattgatttccgcctccacgttcagttcacgttttccttccaggtatttcacccactttggataactcatgatattttgctggatttccttgtacaattgagactgcaaatcccaatctaaggagcttctgggatcatccggtggcaagaattgtaacatgtcaccaaggttcctcgatttagtgattatttgtccaaatccaaccagcaacccatttatttctgtccaaagccccttaggcagccaattttgtaattgagttcttgtctgatctggagtcttgcatttctgcgcatctac

SEQ ID NO: 15456 - DNA, 498 bp, Saccharomyces cerevisiae
ataccggataatttatgtacgagtcatatttgttttgtataactttattaatcgactttttttgtcaggtttatcaccccgttacccatcccgccacttttcagcatcgaggaagaaaaaagggctgtacattatataaaaggccatcaaaaaataccggaagagggcatctccccaataaaggtgccacactgagcagagacagatagggacgcgcatcatgtgttgctactgtgtttgttgtaccgtttctgactttatactgtatattgttgcgttttttttccccccagctgcagtccttcttcgatctgggccttgttcatctgatttcctcctgaatgtattgctaacgctactgggatttttgcccggtatgttacacgcattctactacatcacaattacaagtcctttaaggaacgctgaatacgtctattattaccagcaaggctgggtggatagcgaaagaaacgttccttcgaatcgtcctcaaaa

SEQ ID NO: 15457 - DNA, 402 bp, Saccharomyces cerevisiae
aagaggtttactcattatcgagaacatatggctaattctaaaaaacgaaaaagaataatatgcaaatatatagatatgtgtatatgatacaagcttttttcatgaaaaataaacggaagagaatttttgcttttgtcctacacgaggaatgtatcaaagactattacttttttaagtatgttgtcttagatggctgagttttatgctttttccaaaaagagcaacgtagctgttatttatttacttagttattacctccagataacgtgtctaatctcttacctctatttataaaaattattcattaaaatactattgaaaattggagtatatacttacaaacgtatatatttttttagaagcatcaaggcaagatcaaagctatgccgctttgttcctgat

SEQ ID NO: 15458 - DNA, 463 bp, Saccharomyces cerevisiae
tctggaaagtgattgacatgtcattttttggaaattagttatagatacatagaatatactaaagaattctccttgaagaccatggtcaccgaaaatttcacagaatactacaaactattctcttattgatgtttctccttaacacccagggtgctttagctacaatgaagttaatagcaatatctatatggttgcactggcctctagctgcgaatacgataatacgaatgcgtaggtaaatgataattatcatctatcgattagtgtttcttcctactaatatatcattatatgggtataagaagatggcataaaagttgagaaacaaccatcggatttaatggaggctgaaatgcaaggattggtaatggaataggataatgaatgacagcatataaaatggaggaagaggtgataatattattacgtagaattctcttttttggattcaggatcagtgagg

SEQ ID NO: 15459 - DNA, 474 bp, Saccharomyces cerevisiae
tgaattctttagataaattcttctgtattttttataagaatattagccttcacattgaaatggcttcaacgctcttaaccataatcactagtatcttgcggtgcacgggctttatattgagcaaaattgcgaagggtagccgaattagagaactcttagaaagatgtcgaagctcactcggagtcgaccttcacagcctactgaaacaactgtgccgagacaatcttaagtgtgttgctctaattttcatgctacaactgaaattcatatggccagtggccagaatcacacctatttataggccatttaccagtcatccattcagaaatttagctacttcctcaagcatcagtagtacaaaagctaagactactaagacagatacaactccactaaaattatcaaatgaactatatgcaatattcaagattcataatcgtccatatttggtgaccgagggcgacagagttattc

SEQ ID NO: 15460 - DNA, 400 bp, Saccharomyces cerevisiae
tctcccttgccccagtgtacacatatataaaaatatattcatgcctatatgattatgtatcggaatccaaaaacttatctttatattgcttcgtttcgtagttagcaatgaatcatcttatcatgattcctttttttgttttggccagattaatgtatcacggtcgacggcgaaggcatcaaccattgttgtggaatttcaaacacaatacttgatgactccaaacgtgggcatatattttgatttgaaaagaagtcgagaaagtatagcaacgcattgtatacgtttgaagctttcagcaaaggatataccgtggaaatgtacacgcctatccctgctaatacccctgctcccactgcaccaacttcatcgatgacgtccaactcttcatccgcatcaa

SEQ ID NO: 15461 - DNA, 440 bp, Saccharomyces cerevisiae
ttcgacgcttgaacgtatatatctaatatatatatgttcactatataccatatatgtgctcgttcttgtttccatttttctacttgatctttagacttgttgttttatttatacaaatatattaatgacagaaaatattctttgtaacggctggttctcataatcatattggttgcttggcagtgagaatagactcacttcctgactcatcatcacttccttccgcagcctctagctcattcaaatacaagcagtgtttagcaaagccagggataacgtttctcggtattttcagattggtttcgaacattgtgataaactccaaatctactccatctttcatcccaccagaaaataacccgtactcttggcatatacctgcagtggaccatccctgtaacaactttcttatgattcccacaactacaccaacacggtgc

SEQ ID NO: 15462 - DNA, 456 bp, Saccharomyces cerevisiae
aagaaagcggcaatagcctttcctttcttagccggaaaacttactacgggaacaagttttttttattagtataatgtagatataaaagcttagagtttatataaatataataaaaggttagcactgctgttgcaaaaatatcgaattgtaagccagtaaacttatttaaacggcgctataaccgcctctttgggcggtacttctgcctaagattctcgaaaccacttccttgcagaattcaggtaaggaagtgagaaattgagtagaacgttgaatgaactcagcacggaaatcttgaaaagagcctcctctggtattcaagaatgatacaaccatcaggtatatcaatgtaaacagtagagcgtataggaataaccaagtgaaccacgaagtcccgcctgccttcttagctggctttttcccctcgctgtcaccatccttaccattatcgccgtc

SEQ ID NO: 15463 - DNA, 465 bp, Saccharomyces cerevisiae
atattatataggggtacgtagttattctaacgcaaaatcattttgttttttccttctccgactgcgaaggctgtgccggttgttttgcttcaatggcgtcttctctttcctttacttcgtctattttgtggttacagtgaggacagataaagatgattggcttactggccaatctgtagcaattggatttccaatgacactgtggacatatgatttttttgaagggagagagcgaacttgttgagtccaattcattaccgcctgccagtacgctgatgattttgtcgaaccatgcatcgctgtcttccttctttaggccctttacatggctttccttcttaaatttttctagctctgtctttagattgtttaattcttggtatttagcatttaattcatcatctagaagtaccatggcatcgtcgttttgatcttcaccggaagaaaaccgttggatgattgagc

SEQ ID NO: 15464 - DNA, 481 bp, Saccharomyces cerevisiae
cttatatacccatgacatagaaacaaactcatatgtaaggtattattataaagtgcttctttaaaattcgctgcggaaatttcttcgaggatgactcaaataagaaaaaacgaaaattctgaaagagagatttttagtatggagaaaaccagtactcctgcataagatatcaagatattagataactctcaagatggtttcccaatttgctattgaggtgcgtaacctaacgtacaaattcaaagaaagctccgatccgtcagttgttgatatcaatcttcaaatcccatggaatacaagatctttagttgtgggtgccaatggtgctggtaaatccacccttttgaaattactaagcggtaagcatctttgccttgatggaaaaatcctggtcaatggtcttgatccattcagtccattatctatgaatcaagtggacgatgatgaaagtgttgaagattcgacgaactaccaaacgacc

SEQ ID NO: 15465 - DNA, 410 bp, Saccharomyces cerevisiae
tgtgcccatttacatttttctataatagatttacgtatataagtaatgcttcaacaaagcttaatatgtgtacattttgtatcacgtgcaatatttgtttcaaaaacttaatataggtagggcgtcggggccttcgcgaattctaactgcaaaggaaaactggtgaacacatctgagagggtttgttgtcctaattttataggaaactaaaactcaaaagacaaagtatacctttgcaaattgaaagcttagttaaacattattattcgtgtgtttgaggtcactttttttcgtcttaaacagctctcaaagttgtctcaaaatttttatccggattcctttacattaacagaccccaaacacaacaagttttgatagtttaagtaagtgaacgcttatttttgttgtcg

SEQ ID NO: 15466 - DNA, 421 bp, Saccharomyces cerevisiae
gttacctgatggaaggaatgcggtagaaaatgcacattctttttctttcatttaatgatatttacatgtgattgacgacaacctaatatataaatatatatgcacgcatatattttgtatatgtaacgttaaaaacgcatctgtttttgtgatttcaattatccgctaaaagaaattctgttttgttaaagtaatcttttggtacatattcactgatctcaccttttgtcagccaagcaaaatcctcgaatgcatcatttttcgacgccaccaaatcaaattttccagccaaaatgtgtgacttcacaataaactcagcagtcctatttctctcgtcctgcaaaacacctatgggcgtagcagaaacagaccaagtgtatatctgatcaccgctcaacaatttcaattcgttctctgcgtg

SEQ ID NO: 15467 - DNA, 480 bp, Saccharomyces cerevisiae
tctaaccgttaagaagctaaaaaaagtgaaagattttcaatattacatatgtttttcttattattacttttatcttctttgtacactctattgtttaaatttataacataatacaatcttatcttttgatgtaaaaaaaaataggactatcaatttttaaataatatatcttacgcaaatctatcaagtaaatataaatgctattggttgtacttcctcgtgtgtcagatactttaactgggtactatttacattgtctctaaacgtaacgtttccttgaaatgatctacacatgtttctaagtcactctacatttgctgctgcattaatggcggttcatttgctttttaattttagcgtccactcctaaaaacatgcatgccagtattagatccgccgttatcaccaaggacccactaatgatgtaacatagccataaataattattgttagcaagtatacccgtgaatattggaccaa

SEQ ID NO: 15468 - DNA, 436 bp, Saccharomyces cerevisiae
tgactaatgttttgttgtattttcctctcgtatctatattttttttttttcatatttttttccctcttttctacataacaactatccttcgaaaacgaaatttcaacccctgtatagttactacggagatggaacggcgttcactgttcttgtagattgcatacatgatgttatcgaggcgtattcctaccattaaaagggcttttattctacgcttctgtctttgattttctactttgctcgccgcgccactttcgaaagcttgcatcatgaaatgaaggattttgcatatcgattttttttttacgtgagccccttggtataaaccaaataaagggcaattggtggctccaaacaagtcggaatctccattctatacgtgtatattttaggaagcattatagtctacgaaaagatccattctttccatccattt

SEQ ID NO: 15469 - DNA, 493 bp, Saccharomyces cerevisiae
agtttaataaccccctttttgtttctctagaggagtacttatcggtaaaatattccaaacccttccctttatatatgtagataaacgaagatattctaactctctcacacttataaaatatcgagcctgcagaaggtcataaatatttatatacaaatgggaaagtacttaacgatccgacttgatcaatatcaaatatcgtggcctggtttacattgagaacgggcactatttctttggacgaaatgttgcttaggcaaattttgaagtgagacattgctcgagaatttgttacgtagactaagtcagcatcgccaatgatcattaagcaattggtcgtctcagatgtgatcctgcaattatgagtcctttcaaaattagatacacactcttgggaaaactcaactaagtatttggtgtgaggaatctcttatcgatgcgtataccttgtagtcgcaaacgttataaaattttgtaattttggcgaaatggc

SEQ ID NO: 15470 - DNA, 466 bp, Saccharomyces cerevisiae
aaaatttgaagaagtatgtacgtatgcatacacacatatatatatatatatatatagtacatttaatccttcttgaggtttaaagacgcactgttcacacagtgtctggtgtccttgggcaagtttagcaactgtttccagccttcaccttcaaacacatgtcccaagtgtccaccacaccttgcacaacatatctccaccctcgcaggcattaaagaattgtcacgatgatatgtgatggctccaggggatacctcttcgtagaatgcgggccatccacaacgagcgtcgaacttggccttgctcgaatacaacggtctgtcgcagttggcacaatggtagacaccggactcgttggtgtgtaaatacgcaccggtgttgggcctttcagtggccttatctctcagcaccatcagctgcaatggtgtcagggcatcgttccacttcacgtcattcgattcgtcac

SEQ ID NO: 15471 - DNA, 435 bp, Saccharomyces cerevisiae
ctagtagattgatcacatgaaattttgtgctatatatatatatatatatatatatatatataacatagagtcgtcatacctctcaaaaaagtggcggccagggaaaatatttaatagtttcagttcattccttcgttcatttacagtaacttgtaggaaatagacctttcaatccgtcacattcaccatatgtccacccgctaccgtcatcgcctctgataacagtaattatgtcccccggatcaattgaaatctcatcatctccctgtgcttcgtaggcatatatggcctccatcgtcctaacaggtagtgtactccttcttggtggtggtacttctggtgcagggcctctatcatttgctttaactgtagccgcgctagatatgcgaatatatgtggtgggtacaaggccggtttccccagtggtgtcgttat

SEQ ID NO: 15472 - DNA, 450 bp, Saccharomyces cerevisiae
aaatgcttaggcttcgatttttacttttttttatttacatattctaaataagattaagaagctacgcgttaccgattaatgacacacacgacgattagtaacgaaataagaaatgaataatgagcactcccaggaaggccgccggtaacaacgagaatacagaagtctcagagatcagaaccccctttcgggagagagcccttgaagaacaacgtctcaaggatgaggtactgatcagaaatacgccaggttatagaaaacttttatctgcttctactaagtctcatgacatcctcaataaagatccgaacgaagtacgaagttttttacaagacttaagccaagtgttagcacgcaaatcacaaggcaacgatacaactactaataaaactcaagcacggaatctaatagatgaattagcgtacgaagagagccaaccagaggagaatg

SEQ ID NO: 15473 - DNA, 478 bp, Saccharomyces cerevisiae
aatttaacttacatgttaatggtatgtaagatatactctatatgtattaagcagactttaattagtacttaagaattgaattaaaataggttcgggtaaaacggatagttcttcaaaaaatactgtatttccagcgtttctaaataacaatagcatttgggaaaaccttcttttactattcgaacaagaaacagttttttgtttagttttttaatctggatattcagcagctatttcggcagtgcacacccgcaagaaaaatatacataatgctacaatactcctaaaatattatataaagtatgaataaggttcaagtcgttctcacgagccaaatgaacctcaaatctacatttcttcccctacgaaatgtagtgagattcctgggatgaataaattctttttttgctctttatttgcaacatactaaaggtttaaaactacttgattttgcgagtagcccgacgtaaagaggaat

SEQ ID NO: 15474 - DNA, 433 bp, Saccharomyces cerevisiae
ttttaagagcttcgataaatttgaaaattaattgtactacataaaaaatatgtaaacatcaatatatataatataatcacatttcaaatatatcacgtgttatatttactatataaaaattcaataaataaaaagttagaagataaaaattatattatacatatttttatttttattataatttttgtttttgccttccgaaaagaaaatagttttttgtattacggaaattacagaaaaatgtttaattttgatttcatattttttctttctttgaaagaatattgacgacaaagtattggataattataatgcaaggaaaggatatttgtagatcttcggttcaatgaaagttaatgcggtatgaatattgctttctccaggacctttttttttttttagaggctattttattgtcggtgtttgtggattt

SEQ ID NO: 15475 - DNA, 408 bp, Saccharomyces cerevisiae
ttcagtctcaaaactttcagtacaaaaagtggcgtattggccttgtttttttcttattatgtcttatagtattatatttatatatttatgtacttatccttttatgtttaaacctaatcaagatcacaattagaactagcttaacattacttctcaaaaccaaccaatacctcttatatcttttttacagcctttcccttatgtttttaccatgtacacctcgagcggcaaatctccggggaaattttaaacttgccgcatcgcacattctaaagaacaaaaggaggaggaactgtcaattattctataatctggggaaattcagtcatactgagaaaaactagacaatagtcctatcctcggcaaattgcattgatagtacttacacatcgagagatcataggacag

SEQ ID NO: 15476 - DNA, 435 bp, Saccharomyces cerevisiae
gtaacacgttccctgagaaaccacagcttacatttttgatattcgaaaacaagaatatccgttcgatagaaatttatatatatatatagattctttttattctcttttggaaagaagaaatagaatggacctaagcagacactcagcagttaatattttcgtcccttaattggtattatttataaataaatggcacgtactttatgtgtaaagcagttcatcatcgattgatggagagaatttgtatacgtagagcgatcattgcaccgtttaccaggacaggattcatatggatgtaataggactattacttcactgaatcaatacaactcgtaacggtcatataactgcgagtttgtacgcagttattctgtttgtgaagacagattatacttcgccgttgaaagatttctttacttcaccatcattgcctcc

SEQ ID NO: 15477 - DNA, 499 bp, Saccharomyces cerevisiae
ggattctttttctattccataaaaccattttatggacacgtttacctacatattattatattgtatataagatgttgaaaaaattgagtcaacctcaccttaccacatgttggtccgttgctatgacaaactctcgttttacaagaaggaggctcaaatttcgggtcacccacccatatacggatgtcacgctatgagatcttttaaacaatagacaatttttggtatcctaaagatataaaagaggagtttttttaaaccatggtaactattttcaaatttgctctgctgcagttttttatttctgtttttctttttttgttcccaacaagaagtgagttaataaaggcaaaaacagtggtcgtgtgagaatgaatacagtttcaccagccaaaaaaaaggttattataattggtgccggtattgctgggcttaaagctgcatctacgctacaccaaaacggtattcaagattgtcttgttcttgaggccagagatcg

SEQ ID NO: 15478 - DNA, 460 bp, Saccharomyces cerevisiae
gggacaaacgagaacaagctttcttttttccctaccctaaactgtatacatatttacattcatctcgatatagaaattcaataaaaatccacatgattttgaagattttataattgcaacaagaaaacacaaactaactggtactcctgtcttttataaaacagatttaaatatataacaaatagttgaatgtgaatatgctgtgatttaagtatatttaaacgtatttggcttgtctaatattatattttttagatcgtttatggatcgtttcaaacggatgtaggagcacacgtaacaattagattatatctttgaacataaaaccaatagccttaaaatcaaagaaacgtctccttcaacttgcgttaaaggcataccaaagcaagcttattcaaccatggttacccttgaatacaatgcaaacagtaaactgatcactgcgagtgatgctgttgtt

SEQ ID NO: 15479 - DNA, 448 bp, Saccharomyces cerevisiae
tccttcgattaatcagatttcttttttggtgcgtttgtgtaagaaatatgtccttatatattccacgctatctacttttatacttttgaataagccgcacctaaaaacagtctttatccctcacctaattcaggcgtaaattgtgcaggttacagcatttgaagtggtaaatcgaggcaacacaagactttcgatacttggaggcaagtacgataattacaagggaaaagaagctgtaataaaaggctcataaataatatcttaatagtaaatatctaaatatcagggaggaaaaaaaacctaatgggaaatcataaacaagtcgtagaggaaggctacgctcgaggagtgacgaagtgcgtttaagctggaagagccaatctcttgaaagtaccttcctgtctgcatttttcttgatgaatagccatcaatctttgggcttccaaag

SEQ ID NO: 15480 - DNA, 480 bp, Saccharomyces cerevisiae
tatgcaacgggtcggactatagtttggacaacttccattggcgttttctacattcttattactattccttacatagttatgtttatttatcttccagttatgtaaattttttccttcacaatccatataaaatgactttactacagatgtataaatatgcagtcccgggtgtatttgagaatcgagactacgtcataccggtaagtgggactgcgttttgaaaaaaaataaagaagtactttcggcaggatatttgccaatgtgtacatatcccctcagtgaaaaagctcgaatcaaataaaagaaaaaacctatatattggaaagaagcaaaattttcaaattaaacgcaaaacaactgaagaaaattagagatggctattgttataaacaaaagaaacgtgagagtcttggtaataactaatttactgctcattgttgtgttttttgtgttaaggaattcgaatgctagcgtcaacga

SEQ ID NO: 15481 - DNA, 463 bp, Saccharomyces cerevisiae
ttcgactaaacatacaaggaaagtcattttttctgcaacgtttttttaccctttatgtatatatatttacatataaaataaacctctaatcaatcagtatttaaaaatcggaagtaatgtccatacgaaagggctacgagaatttaaccatctcgttctttgctagaaatggcactgcgggatagcccctggttgcgggatatcagacctgtcgtcaccatagcaaccaaaaattacataaacccatggttgctcgccctttgatggcgacgccgaccgaagcttctcccgcgcacatttttaaaatttttactcatcgggaatgaaaggttctttgacacatgtaaagctccctaagttggacatacgtcggtccttacaggcttagcaatacacctataaggcactagaaacgtataaaatttgagcactttagtttctcatcccttttgatacgaaacgc

SEQ ID NO: 15482 - DNA, 420 bp, Saccharomyces cerevisiae
gaaaaatgatgtagccctatatagacattactaagtatgtacctggtaggagagtgctgtcgcaaagcgacaaaacgtccaattattcaattaatatagtgtaaaagttctcaacgggcttatgctagttttttttgttagtaagcgctacgacgactagaaccatctcttgaatttccaagtgccaaaatcaatgaccacggatactgtggccaggaatctgttggttggtcatcctcaagatctagacaatatcatattgggccagtatctgattatcttaactatatgcgcccctctagtttacaagttttagtcattgggggttggaagggctgatccccccttacaattggcgtcgtttaggagcgggcgaggctctcctttctcttacacatctgctaaggtgtttgttacccg

SEQ ID NO: 15483 - DNA, 423 bp, Saccharomyces cerevisiae
ttttctattaatttgttctctttcccctcggaaaatttaatgaacaaaatactatgatttttttcacctttgatccgctgtttatatttcacttggaaaagaaaaaaaattttttggaataaaatatattcaaatttccatttgatattatcatacacttcttttatccagtcactccttcaatttcttctttattttttattttatgttcctaattttttttttatctctttcctatttcctgttcttttattaatctgaaatattattattactttagtgttagtttataattttaattaggcctacgtggcttgtaataaattgcctcgcatgttatcattacttatataaaagtattattgaaataccgtcgttattttttgatatttatgtgagaaaaaagtattacccggaggagcc

SEQ ID NO: 15484 - DNA, 434 bp, Saccharomyces cerevisiae
gccaaaggttgataattagaatttcctttgtactactatatagatgtaaggaactttaggaggcgttattgagtacgagggatgtacctcattgttaatacgttgaaatatttggatattggggaaacacatgtctgagatgggtcttccaataaccaaagtttataatctttatcttttatctgctttagctagaggttaatagtgaagactacatttggtctccaacaaggtgctacaatttatttttcagccactccgttgcacagcatttatctagccaacgttaatatcaatgagaatggagaagaaagcattagcgtcgttacgctgcaaatcatctatgcaatatgtaaaactatacataaaactttctaaattttttttttttcattttggtatttctgtcagctgccgatgcttcctaaagggtt

SEQ ID NO: 15485 - DNA, 462 bp, Saccharomyces cerevisiae
ttacttcttacccacatccctatttctaacttgagtttttgctagagttttgtatttttgttcaccttccctgcaaaagaaatatgtgtatttatatatgcgtgtatacctatatatgatatgtaaaaatgagacgcccctgttttattttcaaacacttccccgtatagttttttgcaatgacactactttaacttcttcgacatgatttgctttagcactacgaaggattgcatcataacgtttcgaaaggggtgcacttttaaaaaccagtaagtgagtgcctcgtgaactgctattttcgtattttgaaaaaaaaaataaaaaaaaactcccttatatatatatataaatatctatgtactaaatgtcaaatcgctagctctcacctatatcttattcatgctgcaacctcaatggttcactacctcggagaatgggaacggatccccttattatccg

SEQ ID NO: 15486 - DNA, 455 bp, Saccharomyces cerevisiae
tagaaaaatgcaagcacattcatttatcggctaagtcactgaaattttttttttcgagtgattttatcttgcaagctcactctctttgttcttttctcctctataatggcatcttccccccaccaactcctctctacttgcgtgtgtatttgtttgtatacatgtgtaaatatatatacataaaagaatgtcgtctcatgtattttttaacttttagccgcggtcagtgacattttggctttcccaccattccacgtctgaaaaaaaaaaaaaaaaaagagataaaatatgaattgaatatatatcaaaaatgtctgcaaaaatttttacgaatcagtccgattggacttgtacttatcattgatttgctcgttatgcgtcttatccacttgattagctattccctgtaaagtcttagacactgcctcagtggccccaattaacggccgaataat

SEQ ID NO: 15487 - DNA, 452 bp, Saccharomyces cerevisiae
aaaaaagctaggacgataacaaattttatttttataatatggtgacattaaattaatatgtattcttctttctatcaagtgtatgttttatgtatctctaattttaaaagaataattcattttaccttgtgcagtgttttcatcaaacagaaatctcaagatttagtttctacgcatgcattgcctctttcttcttcgttcgagaggagtcacagctaggattcattacgtatgttagtcacacgattatatccaggggggtagaacataccgaccataacttttttgccgtttttctattaaccgcggcttctatcaggaaaccctttttcagcaaattaaaagagagcgaggctaaaactctctggtggcagtgaaagattctaggccgggtccagtttctaggggtaaaatagagcgcaaaagatctcggtgcagatctaaggcggaag

SEQ ID NO: 15488 - DNA, 458 bp, Saccharomyces cerevisiae
aaaacagactaacaatctagcatctagatatgtgtatgaagtatacgtagtttacataatctggaagcactcactatttaccatcagtttctactttttaaaagggatcctcatatggatcctcttcatcataatcgtcatccttttcgtactcataaacaatagcacccccttgtccaaagctttgtgcctccagaaaaggcaatgcgacttgatctttggccagcttctgtttgttggatgttcctaggttgaatgttgttaatccttgcaacatttcgggtgtctccagtccgttactactgctctcctcttcttgcttagtggttgataataattcatattcgtgggtgtttgaatttactatgaagtcgtattccaatgacctgccggactttcttttattaacaagtcgtaattgaaatatatcgttatttaacccgcgaggaattctaaat

SEQ ID NO: 15489 - DNA, 433 bp, Saccharomyces cerevisiae
tcatattagtatatgcccatcttttcttaatctatatctaaaattaacttatatatacaccttcctatccttttattatcgttgtatttcattttttcgctttgctcagagttgattctctttgtttcttgcgccaggatcatccgtctgttcaaggcggagtagtgcaaaaaagtcgagccgtcaagccccaaacgttcaatacttccatgttcttcaacgctaaacgcgacatttgcgagtcctaccacgtcttctccgtttacgggcaaaaacacctcttaacatcaaaaatttggctttcgtgcttttttctgaaatatattcgttgcatagacacggtatgcatatgaaacattcaggctagcaatcaatacttaaaccctttacgggcgtgcatgatgtatcaggaaaccagtttgagaatgtcgcc

SEQ ID NO: 15490 - DNA, 419 bp, Saccharomyces cerevisiae
ttctcatgtttcaataaaagtatgcgtaaatatttacataccactattggcatagatagaatgcaatacatcatgtagttctgtacggcatccgcgcggctccgatcgcccgtcctacttttgcggcccggcgccgacggcctccccggaatttaccaacgaagaggaaaataaactggagttataacgccattggcgggaaactccgaaaccatagcgccgtggtctttccccggttttttggcgccgggtgtgcttgcgttgtgtgaacggcgccctggcagctgagggggaagggaaacgccggaggcgacggcaaggatgaccatggcgtcaaggaacatgcggaacatgctagaatgattgccgaaaggcgggccctagtcaatggcatcatgcgggaacgtgcagtaaagctc

SEQ ID NO: 15491 - DNA, 465 bp, Saccharomyces cerevisiae
tagtcttagtcaatgaagagtttatgtaaaatgtcactattgccataagtaccattattatgtaaaaagctttgccatattcaatcgttacgggtgactatctgctacgtaaagaaaaacgaaaaaacaaaaaaaaaaagaacaagctcatagaagtgaatacgaaagctgaagaaagtcgttaagtagataggttgcgtaaactaggtgcgtccaatcaaagtaatccaattagatatactggactataattaagatgtcatctgaaagcccacaggatcaaccacagaaggagcaaatcagcaataacgtcggcgttaccaccaatagtacaagcaatgaggaaacaagccgctctcaagatgataatgtcaaggaagtcaatggaaatgatgatactaaagaagaggaacaagaagaagacgcagaactagatgatttatttggagatgacaatgatgacga

SEQ ID NO: 15492 - DNA, 471 bp, Saccharomyces cerevisiae
gaggattaaccgagttctttactttttttttagttttatatgtgaaagcaaaattgactgccaacgatggaggtattgtattcctgaaaacaataagtcaaatatgtaaacggcgcaaatatataaatactaagagaataattaaaataatattaaggtacgagatgtggagttcggtggtttttctttatttttcaaactgtgtattttctttgaccttaaggatggctatcaacatcctttgaagtttccattaagacgctaagttgatccaccagttgatcaccttcactttccacatcactttcatcttcctcgtcactactttcaaaggaggcctccaaatcacaacttgatctacagttggggcaaacaaattgcggatatgagagcatgaccaatcttcttacacaacggaaatgccagctatgtgcgcatggtgatatgaaaattgcttgacacggtttgatc

SEQ ID NO: 15493 - DNA, 447 bp, Saccharomyces cerevisiae
atcactttatttctaatgggttaaggtatctatcttttatatttcttatttcctcttcttatatgatgcggatgattttatttcttcaaaaaacattttaaaactcctctttatttcgttatgttccagttcactacgacttcttttctcttaaagagcaaataaaagtatataaatctatattaaatgaaaatcaaaaaaatattttttcgatcagctccttgttcttttcatttcaaagttttttacattgttacacatgtgcatgaatatatatgtttgcagaatatttttggcgacgcttaactcgccatttcagtatatgtcggtggcggtacatatctgggcagagcttcagcttcaacgtgctctctaacttgacaaaagatctgaacaggatcaatgtttacttcagattgcttcctaattccattgattccccattct

SEQ ID NO: 15494 - DNA, 482 bp, Saccharomyces cerevisiae
tttgtataataatggaagtgatttttgcaattgtcctacaaaaactttagacattcgtaactagctaaacaattgatttaacgaataacgtagacttttaattattcaatttaattatagttattgttatttacacaattacggatatcgtatttataacttagtttacatctttaccagaaatatctctatggtcttctgttctctcgaacttcatctgctcttgaccttcctcttgctcttcaccttctccttgctcttggctttcctttggctcctggactcctttttgctcctgctctttttcatcatcttcttcattattactctgaatagcttccaaatcatccttcatcttcccagtttcttcatcaaagtcatattcgtaaaataacataaatacaccgggtgttgaaaggacttcagcttcgtccacaacgtacacagtctcatcagatattctccaccaacaacccctgtat

SEQ ID NO: 15495 - DNA, 473 bp, Saccharomyces cerevisiae
tagaaatatatgaatgtgtacgttggtagatgtattcagactggtgtagtatgtgattcaatttttatttttttagaaagcagaaacaatctaagctattaatactatatacatataggcaaagatatatagggaataggcattttggaaaataagaccatgtgtttttttaacgtagtgaatactaagtacagaaaaaaacatcacctcaaccaaagaaaaattaagtaatgaagaaagatcaggagaaaaatttttttctacttcaggtttaattttctttatctttttcagactcttcctgttctttcaatcttttttcttccaattccttttttacttgttgctctttgttagagtagtccaaatttaatttctcaatttccttttcgacagattcaatgttttgttttgtttgctcttcttgtttcgacaaaagctcttcatgcttcttcttcaattgctcaacggtg

SEQ ID NO: 15496 - DNA, 444 bp, Saccharomyces cerevisiae
tgttaaaaagacatgtgtatgtataggtatgtgtatatcagtaacaaaaagaaatgcgagaaagcttgccttatttaagctcgaaatggctattgaactctagttctaaatgctttttcaataagctaaatttattactaaaatttcgctgacaatagcagcaaagtaaatcgtgttctttcaggtacgtagtttcaatttccttgtcagtgcccaaattttttccgttcaatggtaaatcgtcccaactaatgaagaatccagtattaaatgaattataatgttttttgttcttcaatcttaccgaatggaaatctttggatatgacgtgtatatgtaagttggccatcgaaggcacgctgtgtatcccaacttgtacaaaatttcttacaaacttgtttttgtcttttaatatgtcatcccagcaggggtctttgtcatcat

SEQ ID NO: 15497 - DNA, 462 bp, Saccharomyces cerevisiae
tcagactaaaaaccttttatgtatcttctagaaatttatagtttataagagccgctaaaggtattccttctttttgagaaagtggaaaaaaaatgactaaataatatcatcttggaatggtattttacacaaacttacgtattgagttgggctatacggtaattatgtcacggctaaaattttcattatcaaaaggtatatagggacttgaaagcctcaactttattttcatcaaccaagccatttcctagctgcttagacaccacgggaacattgaaatcaaactcttccgccttttcctctgaaaagtcgttatcaattgaggcgctgatatgtttaccttcattatcgttttcttgtgaaagattggaccgtgatttcttttgaacactattaaaaacaaagcctttcgatgaacttttttgaggagtaaccgaaagatctggttggacgggagtagaa

SEQ ID NO: 15498 - DNA, 453 bp, Saccharomyces cerevisiae
aaggcctttaacaacgtctaataaaaatttactcagtattttctagttctcgttttttaagtaaatacatatattaccaaagaaaagctatttgcaagatatatcgttctttccgatgttttacaatcgtaattactatgtataatggttacatctagcaaatttggaggtttcctaaataaagccccttgcgtgtctctctagaggtacgaaaacaactgatatataatggacccttttctattgtggtgacaggcataaggataaatatttatagatggctaaggaaaataagaaaaatacttctccctattcatgaaccgggcatcttgagtagaatagggtgcttctattcgttagtgctggtattaacttctagtgaaaaatggccgaataatttccgggtaataaagccttcagcacagctcaattagtggaggaaaatattgccca

SEQ ID NO: 15499 - DNA, 500 bp, Saccharomyces cerevisiae
tgctttattaattttcttttgctttactttctgaccttcgtttttactttttggattttgcagttttttcatgctctacttatttagtttatgccatatttaaatttatccctacaattatttgacactgtttgtatgtgtgttcccttcttgaaggctgtgctgaggaaactttgtagttggtacataaatttttgatcaaaagtaaaaatacccccgttcggtaacttatacatttatttatttatttatttgctcagctttggattttgtacagatacaactcaatctctacccgatgcaatagaggctaaatcagtatacgtgtcattttttttaatttggctccttgtgctctgttgtagagaattgattgaagatgatgaaccgtttagtttattctgatttattagtttttccctcaatttcaattcgtgtgcttttctttctaattcttgaattcttttttgtaattctttagctgactgggcctctaactc

SEQ ID NO: 15500 - DNA, 450 bp, Saccharomyces cerevisiae
tactgtgagacatggcggttataacacgtacataatgatatatactctaaatactgcaaattgtcaacaagaggaaatcaaaacaaatggattgtatagtctagttagagctttctcagtgttctcactggattgcagtgatgtgacatagttcaataaaacaaattatgagcaataaaagcaaccgcaggagtttacgtgacatagggaatacgattggtcgaaataatataccaagtgacaaggacaatgtctttgtgagattgagtatgtcccctttgaggacgacaagccaaaaagagtttttgaaaccacctatgaggatatcacctaacaagacagatggaatgaagcatagtatacaagtaacaccaagaaggattatgtcgccggaatgtctgaagggctatgtctctaaggaaactcaaagcctggataggcctcagttca

SEQ ID NO: 15501 - DNA, 475 bp, Saccharomyces cerevisiae
acgtttgtatagataaaagttctcaaaaacttccttccttttttttttcttttgagtttacttatttaaataagaacattctgttttctagggcatctccttctcttatttcttcaacactatttaccagtataccataaagtgaaaattcctattttttttgctttggatattcatttgatcctcaacgaaaaaaaaaatgatgtattttagtattgtacaaaagatattatatgaggctaacgtaaaaaaagctaaactgaggatatatgtatcaactatgaatctaaatgtaacattccgatgattcttttaccatgaggtgtatttcttatggggcccaccagtaaaggcgccacaatctctgatagtcttttatagagatagtcattttgcttatgagaaatgtctaatgctgtctgtaaaacgtaatttccgtagctatcattcaacaatgattgaatacccgtctcgc

SEQ ID NO: 15502 - DNA, 477 bp, Saccharomyces cerevisiae
gtgattaaataggctgaaatcagtgtttagtaactacgtacgttgtacatgtaacattgtgatataaatcgtaagattcgccgagtatagatcaataatatcggtttcatcacttacgttgtttgtgcagtactagagttaagatcgttttcgatcccttattttcttcttttttccttttttttgttatttttctctttttaccttttgtcaccatattaaatctttaaacaaatctaactatgaaaaaatcctttaaacatatgttaatatgtggaaaataaatactaaaataaaaatctagaactgaaggaaatagtaacggattatttaggtatgatatcagcactagattctatacccgagccccaaaactttgcgcctagtccagatttcaaatggctttgtgaagagctatttgtgaagatacatgaagttcaaattaatggaacggccggcactggcaaatcaaggtct

SEQ ID NO: 15503 - DNA, 405 bp, Saccharomyces cerevisiae
cagggagtttgaacagtgctaaacgtttgtcacaaatgacaagattttaattatgtatctatttaacattataatgcgataagtcttgttatcgactaccaagtttcctggatatatctatcagatttttccatttctttcaggtattttttggcagtttcttcatcactaaaattgccccatttttttaacatttcaatgaatgttaatctgacttggataggcattttacctgatgagccacataagaaaaaaacggcgtctttattaactaccaaattagttatttcctcacctaatctccataagtagtcttggacatatttaacacctggtgaattttcctcatctctggaaaaggatgaatgtaaggcaattttgcccttacggaaccaatcttccagc

SEQ ID NO: 15504 - DNA, 489 bp, Saccharomyces cerevisiae
gacgacaaatagctagcacatacatatatatgtatatacgtcatggtcgtcaagccaccgcaaacatatttatctattccttcgcaaatatgctcttttcacttcgatccgcccaggaatcccgacatcatgtcttgtaggaaattcgtttgtttaggagcaacaatattgaaatattcctggcccaaaaattctaactcacttttgtaagcttgagaaaaatctaaataatggttctttaaattcaagaaatagctcttatccttagtctgacaggtaattagcaacaattgcaaaaaatttaggtcggaataatcttcaaaaaaaactatttcataaccatttttatcaattttctcgtacttggggtgaaatttctcaataaatctttccaaaaaaatgtcttttgattcatgtgcaaatgatatgttagagatgaataaatagttgaaaaccaatctgctgaagaactcagccaccgtgctatct

SEQ ID NO: 15505 - DNA, 481 bp, Saccharomyces cerevisiae
tagatatagcgtgcatatacaagtgtttaattgttcttttattcgattattatttacatgcattcttacgtagatgtccgtacctatttgggcttcacgatattcttgatggatgatctagaattccccgagtgaaatagggtcttggcagacgtatgtgaaaggatctgagttaatattgacctgttcaatagcttattttctgccacactgttgaaaaagcagtccaagatcctggcgtcattcttcacaacgctaccagatctcgagaaaatgtaaaatttattgaaaaatgagggtgctttttcatccactgtgaagaaaacaaaggtggccttatcctccataccttgagaacctactcctgtgaagatcttggtggccttatttttagacagttcattgatctccctcgtgatagaaactggtcttcctaacaagtaagtgcgtcgagtcaattgacaccgtggcaccgtactat

SEQ ID NO: 15506 - DNA, 478 bp, Saccharomyces cerevisiae
ttatttgattagaagtgccgcactgtttagaagaaattgcatattctaacatttaaaattttttataatttttctatatagtcgcttttaatacaataagacagtactttctttttgttcaataccatctttcgcatctcttctatgctatatataatgccacgttgtgctcgaaggaaaagcctgcaaacctgactactactaatacaataatgttccatcatatcaagaaaactgcgctaacttgtaaaaatactgtcaaccatattctcacccagactataaagttaaggaaatgataaattataagtgatggcttcccgtttatacattgtacatatatattatttatgaaattgaacagataaaaaagaaggaaaatacaaaaattgtggatgaaaaattctttgatgaagtttttagatctatttcttcttttcagcttcagcttcagccttttctctagctctcttttctc

SEQ ID NO: 15507 - DNA, 491 bp, Saccharomyces cerevisiae
gctcattcaataaacgaaagtaactatcaaatgaaataaggaagcagtattaggaaacggtatcaacatgttcgggtcaccctcatttttatttgtttcctttctttttttttgtttctctttctcttaaggtttcctcccccgctgttaattttaactacgtgtgtattttttaataattaattttatcacaaaaaaaacttctcatcttttttgccttttatcatttttgtacttttttcttcgcttaaaatacacatgatatagacgcttaactatctgtcctgcaagtttgtttatctatataaatatagccagtatcatccgtttacctgtgttgtagagttccaaaagatagaacagccttttatcagatgggtggcagacccttacccatattatctctcttattttgtttttatttctctctagccttataattatttttagtttcctttctgtagcaataagtgttcttagcagtggcgttg

SEQ ID NO: 15508 - DNA, 400 bp, Saccharomyces cerevisiae
tagtataattgcgatcctttttgaaaagggtcctgacttttcattttgaatgttttttagtttttatgtagtggaaaatacactaaatcaacatatatatgtatatatgcataaacatatggatactgggaaacccatgttaacggctgaatgcaatatcatcaatacgtaagatggatttaacacattcagacgctaaggtaattgcacttgtactaacaagtacgggttgtaagatgtgttcttcataggtgttcgtagtaccagatcgtctaacagagataccgtcattcaattcaccattttcatgcttagagcgcaattctgtgacaactttgatactattcaaacctgcgttttcagccaaagtcgttggaataacttccaaagcagaggcaaa

SEQ ID NO: 15509 - DNA, 460 bp, Saccharomyces cerevisiae
tcataacgcagcccgtcagcgaaaaaccgtagccatgtatatataatgataataatcatctataatacactactattactttagtctcatcttacgacagcctttacgacggcttttaccgccttaaaggcggacaggctttgtcttccggaacggaaaaacatgaaaattttttattttttttcattcgtttataccgcgagtgaaaaaaaaaaaaaaggaaactggaaacctctcgaataacgatcggtgaatgcttcccaagctgttttcggtcttcgtgttgtgtcaagtgagagagcagaacgtaaacgcaaacacaacgtcggttctttccgttggcgttcgttgtttgtttattctcgtttctttgaacctgtttgtttatttatttttaaacagtcaattagtgagagtaacacacttctaatcttggccttcttattcgtagccacccagc

SEQ ID NO: 15510 - DNA, 412 bp, Saccharomyces cerevisiae
gaaatgtcaatcattattgctaacgttcgcgatggttaatgctttgtattcgcgctatctcgatttctacctatatagttaatctctgtacaaaaacaatctttccaactatccattaatcatagtatattatcagcgtcggcgattttaccacgcttgacaaaagccgcgggcgggattcctgtgggtagtggcaccggcagttaatctaatcaaaggcgcttgaaggaagagatagataatagaacaaagcaatcgccgctttggacggcaaatatgtttatccattggtgcggtgattggatatgatttgtctccagtagtataagcaagcgccagatctgtttactgtaaaattaagtgagtaatctcgcgggatgtaatgatttaagggaatctggttcaggttttc

SEQ ID NO: 15511 - DNA, 439 bp, Saccharomyces cerevisiae
ttctaagcatggattaagaggatattattattttatcttacataaatatgtacgcgaattgaaaaagaaaaaaatattgtgtagaatgtgtattaggcagttatgtatgtagacaattttgttttgtatttttatcaaagtaaaggctggaaaaccggctgtggtaaattgccattttgaaaagaatttttgttctttgtaacgtatggcgctggcacagactcgttgtggtcattattatttgtgttggaggtggaggtgccagtgtttaaagtagtgttgctattttcttcattcattggcgatttagagatcctattaaggatgttatcaaaggcagttaagcttgatttttttggatcatctttttcttgtggtaccaatggaatagaaggcatagaggggttttcacctatgcatgacattttgggcaacgtaa

SEQ ID NO: 15512 - DNA, 478 bp, Saccharomyces cerevisiae
gccaaataaatagtttcagcagctctgatgtagatacacgtatctcgacatgttttatttttactatacatacataaaagaaataaaaaatgataacgtgtatattattattcatataatcaatgagggtcattttctgaaacgcaaaaaacggtaaatggaaaaaaaataaagatagaaaaagaaaacaaacaaaggaaaggttagcatattaaataactgagctgatacttcaacagcatcgctgaagagaacagtattgaaaccgaaacattttctaaaggcaaacaaggtactccatatttgctggacgtgttctttctctcgtttcatatgcataattctgtcataagcctgttctttttcctggcttaaacatcccgttttgtaaaagagaaatctattccacatatttcattcattcggctaccatactaaggataaactaatcccgttgttttttggcctcgtcacataa

SEQ ID NO: 15513 - DNA, 408 bp, Saccharomyces cerevisiae
agcaaagatttttatctatgtatgtgtacaagtaccatgttctataattaaaattattactatttagacgcatttctcatcgaaaggaagcaattccataccactccaactgaagagctaaaaggtgcttggaaatctctaggcattataaggaaattaatgaattgtaccattggccacaccagatagttacaaccaagcgtagatatatatagcctttggattttcttgccaagggtgtccttatctccaccttccatcacatagtttgagaacataaagaaacaatagagagagattggcgaataaaggagctgatccgaaagaaccctttcaaaaacctgtaccactgtcggatcttcagtgtaaaagaaattcaagaacttgtaccaaggagcctggaaaaat

SEQ ID NO: 15514 - DNA, 430 bp, Saccharomyces cerevisiae
gttttcacccccgttctttaccacattgtttctaattattccgttagcgccgcttacttttaatgttcttaagataaaaaaacatcattaatattattattaaaaaattcatatatatacctatatctatatgcactatttatgcttccacttttcttttctttctaaatacatcattccaagacgtttttgtccatcttatgtaatgcatccttgatgctttgcaattctactttctgtccacgaacgtgcaatccagatgcaatgttctctaacgctgatgagatcgaagttgaatcctcaggatttagttgttcttggatacttttatttttttgcatatgttgacggattttttgatatgtgtaactgatcggcagatacctctttgcatcggaagccgcattcatttgtgcattcttgcaggaac

SEQ ID NO: 15515 - DNA, 451 bp, Saccharomyces cerevisiae
gcaatcattcgaaatgcaaaaaaagatatgcagttatagaaagtgataaaaacattttttttcttgactttttatgttatataatatgctatatatgataatatctagtggtatcttaaaaaagaaaaaataatgaaataaaagggatagtacaaaggactgtgtttttttgtattgtggaaaaacgaactaattgaaaaataaaccataaaatgaacggagtaaaaaaagtactagcaaaagcttatttgcaatattcaaggaaaaaaggcctagtagaagacaaagttagcagaaccagaagtaactgaaacagtacaaccgtcagagccagagccagagtagacaccattttcgtaagagcaagcaccattgacggtagagccatcggtggcaacgatcttgatgttaaagtttggtgcttctttgttgtttgggtttggaatgatgg

SEQ ID NO: 15516 - DNA, 449 bp, Saccharomyces cerevisiae
aacatagctcttgtctgtaatcaaaaaaatttgcgtcaaaaaaaaaaattagatgtatgtaaacctttttattgaactgaaaatttatcttttatcaaatctttttcttctatgccttaattatgttttcaggtatcttttttctcattatttaatttagcttatgtattgatcatttcgcttgagatttcaggaagaaaaaacgcaaacaatttttcagctaaaatgaacccttggaaaagctttaagagaacaagagaaactgtagagctcagtgtgcattgtcttcaagattgatggctattcaaaaggttagtaacaaggacttgtcccgcaaggacaaaagaagatttaatatcgaatctaaagttaataagatttatcaaaatttttactcagaaagagataatcaatataaagatagactgacagcattgcaaacggattta

SEQ ID NO: 15517 - DNA, 491 bp, Saccharomyces cerevisiae
tgagtatatatatttaaaaagtactaggattcaagttaacattttgaatagaagtagttatgttgttgtaatataatggagctaccatatatgcagaatgacattataaattatgatgttgatgtacaatgcctttgtgcgcttcttttaccatgaattttttcttaacctctttcacttttctttccgactaggataatctcgtgtctaagtttcctggttcattaaacagcttatcattaaatctctataacggttatattgctccttgcaacgatcaaggcattccaaaagatcttcatcgtcaccatcatccttccaaaaacctacaatttcctctccatttttgatgaatgatacgacagtgccattggcctcaccggcacctgccatatccactaattcgatgccggcatcagctaaggctagcgttatactagtgatacaatgtggtatgagagatgatatttgagaagacatcattttgcttt

SEQ ID NO: 15518 - DNA, 466 bp, Saccharomyces cerevisiae
gaatatggttcaatttatgggaaatatacggcatgctttttaacaagcgtggtgaatgtattatttttttatctgttatatcttaaatacgactattatatatatatccatcgtctttttcctgactctaagcggtggcagctggaaggtagaaaaaggtatcgcctagatgtcaaaatatgaaaaagtgaaatgaatattaacaaaaaaggagcgtgagctgcagaaagaatttgaccaacaaaagacaattccactcctttggatttgaaatagacagatagaaaaggatatgaaagtattacaattcaatcaagatgcaacgtgctgtgtggtggccgcgtcatcgcatcagatttcgatttttaactgcgacccctttggtaaatgttttgaaattgacactaagaattccaagaagaagacttcaaacaataacggttcagcttcaaactcagaatcacgg

SEQ ID NO: 15519 - DNA, 443 bp, Saccharomyces cerevisiae
taaaaagcagtattgttttcgaatatgtattatttttttttattttttttattactcgttatcaatatatatatatacatgtatattattactaaaagaatgagaaaataagataggatcctggaagggggatcaggtaaagatataaagtgagatgaagaagccaccgttttatttcccctttaatttgttgctgcaggtgcctcaggcggttcggtattgctctttggatccaaatatttttcaaaagcctcgttcctttccttgaatggccttggacccaataatctaatcatgtcttctctagtaattgcttccttacgtagcaattcttttgcgacaagatcgactttgtccaaatttttggttagcaattctgtacaagctcggtgtgcatcatctactatagatttaacttctaaatcaatggttcttgccgtttt

SEQ ID NO: 15520 - DNA, 407 bp, Saccharomyces cerevisiae
tctcttcgtactatccttcatgtcgccttttattataaagtatgctaggtagttttatctatatcttatttatgacgcaatatagggtaacagagtttttctgctctgaaacttccgcagaaaaaaaatcaagttttccttttcgtatcttggattattgttatataatagatgcatgtattatatgtatagcagtgatttgcttattttcttgattctgaggaatcgaagaagtaacttagcgtttcttccgttgagcagagcagtataataatccttcaaattctttaggttacggggttttcctgttgcgatgaccgaagaaactattactatagattctatttcaaatgggatactgaataacctgttaaccacattgatccaggacattgtagctcgggaaa

SEQ ID NO: 15521 - DNA, 417 bp, Saccharomyces cerevisiae
ctattagatatgcttgattcatgtccatatgtatctatttatacaaacattacgtaatatacacagattatacatgaaaggtgctcttcatatttggcttcttgcttccactagcctatcccaaccaggagagtcatcccatctgcctttgcctttactcattagagctttgatagtagatctacatttgtatttccagtctttgcaaaccagactgcctggcccatatttaccttccatttcaccaagtgattcataggcagccaccaaatcttcacaagcatccactgtatcattccaaaccttttcttcaacttctaaatcaggattgtgagaaatggccctataagccttctcgtggcattctagggcggcccatggtctcttcctccaaagttctactcttgcgaccagtcg

SEQ ID NO: 15522 - DNA, 482 bp, Saccharomyces cerevisiae
aaattgctctcaatttctttatacatctgtcacgtaaaccattgaaaagattagattagtgccgtaatacttatactacatagttgtgccacactatatttttagtgtcctatatagtccgcaattaccctatgcctttttttcagtcgcactgaaaaaaaaaaaaatttttcatatttccacttataggttgatttgatttgatgggccttttggaacttttcacaatactacaaatacccacacacgcagttcagtggtctcttcgagttcatcatttccattcgtactccttgagcttttaccttccttcctcctcccctatatactcaacttctcagcccacatcaataatgatagcaccagactcgcaaagattattcggttcctttgatgaacagtttaaggacttaaaactagattcagtcgatacagaaaacaataacacacacggtgtttctactatcctggattcctcccct

SEQ ID NO: 15523 - DNA, 460 bp, Saccharomyces cerevisiae
gccagtcatatatacctaagcaactattttttacttctttctagctattcatctgttttttattttcttcttcttctagtaacgaacggctacatgagtatatgcactcatttagttagtatctatgtatatgtacggaactaggcaaaccaaatggattgctgttgtatgagatccgtgtggcggaaaccatgactaccgcttgtactgccggggccaaaatagcacacgcgcgtcatgagtcgctcacgggcgagcgtctatctgcatattttcctgagcccaatattcggttctgcgtcttagcggcataaatgcatccggcaggactgccgagaaaaggaatatacaatggcagccctcttggcgcatttgatgtatgcggatttccaaccaatctgcgaatgcatccgtgccaaaatgaaacggcatttagcttgaaagagtcggaattcctgca

SEQ ID NO: 15524 - DNA, 446 bp, Saccharomyces cerevisiae
gctagcaagtaatgatggtgcggtctacatcgagtaaaaagataatatgtgaaggtgaagttaaagagtacaaattggagattttgaatactacatttacctagtaaatcacgatgagaattatataagtaaaaggaaactgtttacagtttttcgaaatcttcttcattatatacgaagtcgttaccgcaacgtctcgctaaccaactttttttataatcaaagtatctccatgattcctcctcagatttgcccattcctggtggtaacttttcgatttctttataataccagcagcgatctaccttgttgaatagccagtttctatttttaaaaagttctctagcagctaaaaactgttcatatgatccttggtaatgatagaatatgaaaaataaagtatcaagatcaaatttcataaatattctggctagtgaggttctgga

SEQ ID NO: 15525 - DNA, 431 bp, Saccharomyces cerevisiae
gattatccatagagagaatgaaaggttactaatatagtatgtatacgtgcactattatttaattttactttatattgcctctaattattctcaatcacaaccaaaatactttgaatcaaaaaatctggtcaatgcccatttgtattgatgattttgtaacttttctctggagatgatcataccagcaaaaatgttgactttgttatcaaatgcatttaatatacgtcggataccaacttcagtggccaaataaaccaccacgctaatcttttccaaatcaataccatgatctaaaagcacctggatggccatgatcatggccgcaccacttatgatttgaccttccattaagaaaaccttgccaaacttttctatatttgggggtaaaaattcgcaatgcagttgaggttccccagtttgtgaatcggact

SEQ ID NO: 15526 - DNA, 446 bp, Saccharomyces cerevisiae
ttcgattaagaagtgcaacatgaattattaagttaatttcatatatactattttataattaaataacattaatcctcattgattcattttattcatgataatgtactgtccggttccttgcgctagcctgagttagtctccgaatacctggcgattttcatatattctgagcggctctggacacctaactggataaaaatacttccacttaatgtagtttggttttctagttcatacggactatttcaaagttcatgatttgatgagagaaagtagctatactatcttcccaatttacgcttgtctctgaacaaaggtttttatcctttatatgcttattgaaatactgagaataccaaaagttgtctttttctctactatcgcttgattctttcaagacgtcggatataagaaatgtcacaaaatcaaaaatagctgcgaggaaa

SEQ ID NO: 15527 - DNA, 414 bp, Saccharomyces cerevisiae
aaagagcatatttgcgaaggaatagataaatatgtttgcggtggcttgacgaccatgacgtatatacatatatatgtatgtgctagctatttgtcgtctttaatgatagcagacctattaagggcctccaacaattcaggcctcttggcgtctatcaagttttgtttagcttctgtataagagtatagctttctatgtcttttgtgacattccggaaatttatcaaggagattttcaatctctaattcataaaaatgaaattcggttcttggcgggtgctttgctacttctgaatcttttcgagagttctcgaattgcttaatgtctttgttccagtccttagggggtctcatgtcttcaactgtacccaaattggcgacaattttacctatgcaaccagcttcctcccaagtt

SEQ ID NO: 15528 - DNA, 417 bp, Saccharomyces cerevisiae
tagaagatatgtcaggtattggtcaaatatatacttttagttaatactggatatgttataaaggttctgttaatgccaaatccatttcaattcttttcttccaaatattgtactggtcgtctgtgaccaaaatattggtggtttgtaacatcgatcccagtttcctaaatataatttcatcgtatctgatgccatcaaaatcatcatacctaatttgcaaatctctgaaccatttttcaccgataattaattccttcactaattttacacattcaataacatcatccacttttgacgtcaacatcaagctgcacatcttactgactataaaatggtcaattcttggatccttgcgtcttctttcattaaatacaatgaatgtacaatttaatactaacccacacactaattgccatg

SEQ ID NO: 15529 - DNA, 458 bp, Saccharomyces cerevisiae
actaagaaatagagagagcactacgtagtccctcttttaatatgtaacgtgtcgcttctatttatcagacataatagtaattactttgttatttttctatcgtttccttactttagcctctgatttcgatctggcctaatcattgtgtacgtctataatcatatggccctgagcgtacacaccgttcaattcttctatttggtcggcccacacaaattcgcgcgggggcatattgacgcgtggaagaatagaagtccgcgtagcagctctggggtaattaggcttttacgatatcggctggcccagcaccggtttttattcctcccgtggttgttgtctctaccgtgaggaggggaaagggtcagggacggccggtagttatgttgtctcaacgattactgccatctattgtttacaccaatcgcgtggggcaaggggctggaaggctgtggtgtaca

SEQ ID NO: 15530 - DNA, 495 bp, Saccharomyces cerevisiae
cgcaaataacacctatataccactatattgaacacatacatatttttataacaatgggctatatcttttttgtattacccgcgtaattgggaaaatttttccttttaaatagcagcgtttgggatcaaaaatggcagtttgatggtagattaggaggatttagtgagcccagtgggaccaagagcaaagcgcaagatcatgtcagaccctatcagaacgaaacccaagtcgtcgatgcaaatcgacaacgcccctacgcctcacaataccccagcatcggttctgaatccgagctatttgaaaaacggcaacccagttagggcccaggcacaggagcaggatgacaagatcggcaccatcaacgaggaggacatcttggctaaccaacccctgttgttacagtccatccaggacagacttggctcgctggtgggccaggacagcgggtatgtggggggtcttcccaagaacgttaaggaaaagctgctgagcttg

SEQ ID NO: 15531 - DNA, 429 bp, Saccharomyces cerevisiae
gcaatccataaatatgtaatagcaccgttctgggagaaaaggactttttacttggtaaccaggcgtgtaggttagatagtcaaaccctatatcgttcttgagatcgtcgctcatatatactgtgcagccggccctcgtgcgcctgcgccgttccttctctgaaaccttcgtagtaggacaataaatatagtccccattgcctattcaaattatttgcaaccgaaaaactgcaaaatttgttgttgaccataggcgtacaaaacacaactcaatccagccgtaagtaagtatagttatgacttcatctctagatgatatagaaccaacagcatataataatatggaagcggacgaggaatattgcagacgcaacgatatacatgacctttccagcgtggtcggtgatgctgtctcacaaggtgtgccaga

SEQ ID NO: 15532 - DNA, 455 bp, Saccharomyces cerevisiae
gaggagtgattttacacaaaaagtttaagatatgactatattatttttattattgtatctacttcgttttggctcttataattttttagtggcctaaattttcaaaggaaaaatttattgaatattttgaatgatatttaaactctatattttgaaatctatacattgaatacatataagataaactgtgttgctcttattgtatatctagcttataggaaataggctctcgtgtctcctcactaacgtaatcagcaacaccgatgaatttattccaaaatttgtataccttcatcaaagataattcccagatgttcctgggtaaatccaaatagcttctataaataaatctgaatgcttctaaaacgttgttaacttcagtattccaagctttcttccatttatttactgtaccgttagagggccttggaactatttctgctttgggcattttt

SEQ ID NO: 15533 - DNA, 402 bp, Saccharomyces cerevisiae
actgtgaaactaataaaaacctgtcccgcacaatctggtacgtaggatggataaaataaataagtaaataagaaaagtactttaattttcaacgagatactggctgcatagcttgcctagaaaggagacgtcacgtcacttaggcaagaaaaaaggaacacttttcataatattcatcataatatcagagatcggccagcaataaaaagatataatgaaggcaacgatgataatggcttacctcctcaccacataccccttacagaaaaaaaccaacatttctccggagaacaggtgcaaggataatccacatgccgaaaatacgatcgacactgattccttttctggtatcgtaaggggaaccttatgcggggtaatgcacttatcaggaaattccgcagc

SEQ ID NO: 15534 - DNA, 407 bp, Saccharomyces cerevisiae
gtgctctatttctatatattctataatgttagaagcctatgctattaccgtttctatatagctccataagcaatttcttcgcgaaagtgaaaaaaaaaaattttaatgcgatgctctatttaacaaggaatacaatgagagcatctagcgcacacaaacaactacaaaacgcaataacgacacagcaagaatgagtctcagcacaatcatatgtattggtatggccggatccggtaaaacaactttcatgcaaaggttaaactcccacttgcgggcagagaaaacgccaccatacgtaatcaatcttgatcctgcagtattgagagtcccctatggtgcaaacatcgatatcagagactcaatcaaatacaagaaagtgatggagaattaccagctaggtccgaacg

SEQ ID NO: 15535 - DNA, 495 bp, Saccharomyces cerevisiae
gttgaccgcccatattaataccttaaaacttatttcttgaacctatacatctaaatttaagtaatattattttatttgtataaccatatgtagtttacctgaaatatatgggtgccattaagaaaatataatacaatggacaagaattttgtcctagaaaataaagtcttgaaagtatattgtcctttcctttggaatattatgtcactagcaagcatcgaaaattgatccagagtgaaaattaattttttcgagattaaactgtgaattcaaaagtttgattttaattgtttcctcactcaacttggtactgaagtcttgattagctgttagagaagataattctgaccgtattgaagatgtcgaatttactgaaagcaactgaagtaaaatatcgattacttcaatcttgtttttactgcttatgtaattattccaaattgaatccgagataggaatatgaatatcaaatgtctcttccatgggatttaggca

SEQ ID NO: 15536 - DNA, 412 bp, Saccharomyces cerevisiae
tactaaactatattatgtaaaagggtatagttatagtttttagctactaaacttttattgggtttgcgatgagcgacagttttgtgcggccatttctgtgccaagaaccggattgaatgtatcaccgaaggaattccgcggtgttttcaaagaaatgaagagaagacagtatgaacattaacttttgcatatatatacgtaaacgaaaaagatcaagtgcaatggaagaatattgtacctaaaaaaaagggtctaactacagcgtgtaacaggttaaaaaaacatgggtaaagttattttagttacaggtgtttccagaggtatcggtaagtccatcgtggatgttcttttcagtttggacaaggacacggttgtttacggtgtagccaggtctgaggcacccttgaagaag

SEQ ID NO: 15537 - DNA, 463 bp, Saccharomyces cerevisiae
tgtgatggcctacacacttcgtcacaactagagctttatgccaagattaaacttcaagttatataaattatgtaaacattggacatacaaaactcggaaactctttttctattcatcttcccttctcgtacgtgcccacggaagcaataaaaagaaccgaaataaccaacacccgtaacgtcaaagcattcatgcttagaatggaaaccatttcgtggaatgaaatggcaaattgatcacattgattgctcgttccactacctgtgtccgcaattttttaatggtcatcacagcccctgctgactaaagttcctcggatccgcttacggttgtcgcgcggttccgcccctgcgtactcttagtacctagcatatgggctccctccgttggattggcatcgattagtaaggacagatgttaaggatttaagaccgtttttaaggtatttcggcaatgcttcgat

SEQ ID NO: 15538 - DNA, 468 bp, Saccharomyces cerevisiae
aaatggtaaagttttattttaaagggcacaactaaagaaaaataatcaaaaaaaaggtgaaatagatatgcaagaaaagaaaaaaaaatacaatactagtaaactgaaataaaaaagattagccataatggatttgtttctctttgttatcgatattcttacctcttgaagatccatgtgtctatcatttgaattgaatatataattatatacagtgagatataccaattgcagtaacaaaatggcaaatatgtatatcagtaatataattagcatataaaataaaaaaaaaaaatgcttatttgtcacccgctgactgcgtttccttttgaattataaaaggttccttatggttctggtccactagcgttttattttcttccttttcctgtaatatttttaactttagctcatgtactttgtgcttgtctatatgtttctcgtatttttcctttgtcttgaaagtcc

SEQ ID NO: 15539 - DNA, 462 bp, Saccharomyces cerevisiae
ttatattcatgagcacatgtagtttttttttttttagttttaaatataagaaaaaagatagtatatatatatatatatatacatatacatataaaaggaaagtaagcttatacaatacacaaataaattcatatcaaagaataatgaaccgcaatattcagaaacacaggaaaaggaggggaagggatgaatggtgaggaaagtaactgtttgttttaaagcgtacctggatcataacataacaaataagtagataaaaaagaatagagagaaagatataatgacaatgaattgaagaatagtttagttagttacatttgtaaagtgttccttttgtgttctgttcttaatttggcgctatttttttatacttccaaatccttgctttacaatcaccgctaccagtagcaaaaacgttatattctggacccagcggagacccgtttgccacagccacagata

SEQ ID NO: 15540 - DNA, 468 bp, Saccharomyces cerevisiae
cgtggtatgtagttatattagaaattgatattttaattatcctttcaccttaaactaaaaatattatatgtatgaagacgaagacagcaaaaagtatgcgtgatacagtttacattatagaattctttccccaaatattgagggttttgttttttttttttaatgcagatgtacgtacatattttctttatcaaaaggatgtgtagagaactatgtatatatgtatatgtgtaggttttttttttttaggatgactagaaaaggaaatcgaaaaagaaaaaataagcatgaatcatgagtaggttaaaggcaagtcgaagaagatacgaagcaagtgaagccgtttaactggaggatagtctaaaccataggttgtagttattctcaatgatctgatctgagatcaaatgatcatcaattagatcgtttgatcgtggcaagttgttttcgtaacccaaatgtgccttt

SEQ ID NO: 15541 - DNA, 433 bp, Saccharomyces cerevisiae
tcccaagacttatatagccctacgtattgtagaaggatatattcagtgttaatcgttatttagaaacattacgcccgtgccccgcgatttcgcttctttgagaagtggaggaaaagaagggtccctttaattccagtagaaatgaagcataagcaagaagagtcatcagaaaagggaaccttgtagtactatagatggtcccacagagaaattaattgggacaaaaacagctacacaagcgatatacttcaaaagattcagatattgaaaaattaccagccatgcctcctccaactgcacagttcatgggccctacgcaggcgggacaaaatgaaagccaaaatcaatcatcaggcgaagctggggagcaaaaccaggagcatgggcaaggccctactcctattcttaatcaaagtcaaccggcttcttctca

SEQ ID NO: 15542 - DNA, 424 bp, Saccharomyces cerevisiae
gaagagcccacctattctttttctgttcaggcatacaattcaaattttatacgtactagatatttacaggtatgtaagaatgaaataacgatgtttgatttactgttgtaattcagaaattggtttcattccagaacaaacatcatataccaatttcttttcctcggagcccataacaacagattgtaatgataacctcacaacttgactattttgtacgagcttactcacagtatctttagatttcgtcagtttttcaaaatcttttttcacatatggttttaagagttgatattctcctgttacttgcctatgaaaatcttctgggtcttcttcaataagtaaattctgcaattgaggctctttggcaaaaatcaaggaggatcctggtgtatatttaccaaagtttggcgtgtttagggtg

SEQ ID NO: 15543 - DNA, 477 bp, Saccharomyces cerevisiae
taaactcacccaatgaccgatatattgtgtttctatactgtgtttgttatatatagtttaccttttttagacaaaaaaacagaattatatattatccttatgttttgttatttactcggaagcacacaattgcccaccacacaaaggaggtggaggaaacaattaatttttcacacaagaggtatatatttggagaaaaatgaagaatgagatacttttcttccgattacttaagtattacggctctgaaattttctcgagcattagatgattaaatcaaaatgacatagtatttcgcaacctttcagttgggctttgtttaagaagtggaatacttttgcttgagttgtttagttttattttatccactgttgtcttaacaaatattttcaagaccggtaagccgaagatgaaaaatcattattaactcattttttgaacaaaaatataaacaaaagaaaggcaacgcacaatttt

SEQ ID NO: 15544 - DNA, 432 bp, Saccharomyces cerevisiae
atggaataaatataaaacatgtagaattgtatatatacgcatatatgtatacaatcgcgacaacttttagtgaaacttctttgtatccagtgaaaatgaaaggaacagaacctgaccaaaggtcagtagaaaaaaaaaaagccttttatagaagttcttatccaatcgttgacattttgtctgctctatttaatgcttcaaaaatctgatcccaaaagtactggatattcaaatcgagaccaattattgtaccaacatcactgtcatttggatattctttttcaatgataattttccctgagttttcgttgaaaacatcatcaatgcaggatatgtccattctcttgtagcgaaatccaaccgcagacgatggatcccacccataaaattccaaaagcggcatcaaagctaccggatcatgtataggtgggc

SEQ ID NO: 15545 - DNA, 491 bp, Saccharomyces cerevisiae
agaaaagaagatttttgcttctttgagaattaatcgtgaactggaattagagctataaatcgcttgattcttttttccctttttctcaatattcgcaggttatttttcctttatatatatacattgtttgtatctttttttgattaccatacttactatttttatattagtcatattagatgtcacttttatattatctaaacaattcaaacttctcacactaactttttcagcatacttctactgttgttctctgctctggaaggtattttcatcaggcgattggtaaaaaatcaagaaagaatctaaaaaatagtgcaacaggaaaacgaggttcccagtttccctgggaattcttatccaagtatatattttacttttaagattcagcacttttatttcgttctaatgtttttaccggtagtaaagttttgcttcttgaatccactattcaactacttgcgcttatgtaaggttcctgtatggttgca

SEQ ID NO: 15546 - DNA, 422 bp, Saccharomyces cerevisiae
ccgtaagcgctattttctttttgttcgtaactatctgtgtatgtagtagtgtaatctacttttaatttactatgcaaatagggttcagcattacggaagaaactgaaatcccttccgcggaagtttcttagtagtggccgtgcggggtgaggagattacatgtcggtaattagatgattaacctaggcaatttgaagggggatagtggcattggttagctcagatatgataaggagaactaagcaagggggttaaccaccacggctgtagcacaagaccggcagatgcgattattagcaacacattagttaatgcttttgataaaatgtatataaaggctgtcgtaatgtgcagtagtaaggacctgactgtgtttgtggttctcttcattcttgaaccttgtcattggtaaaagaccatcg

SEQ ID NO: 15547 - DNA, 402 bp, Saccharomyces cerevisiae
ggttggaaagtattgtttgacttcatgcttatataaatatgtacgcatagaaacatatctctaaaattaaaagtgaaagaaaaaaatcgctaagattcccctttcgggggaaggctgaagaaacttttttttgcgcaaatttcaagatcggaatcgctcgagaggcaaatataaaaaagggcctgctcgtttggcctacttgttgttggattctaactccaatctaattttggcagcacttcaaaaataaacaaaagcgatgtctgcgtcactagtgaatcgatcattgaaaaatataaggaatgaattagaatttttgaaggaatcaaacgtcatatcaggcgacattttcgaattaatcaatagcaagttacctgagaaatgggatggaaaccaaagatc

SEQ ID NO: 15548 - DNA, 478 bp, Saccharomyces cerevisiae
aatacgatatccgtaattgtgtaaataacaataactataattaaattgaataattaaaagtctacgttattcgttaaatcaattgtttagctagttacgaatgtctaaagtttttgtaggacaattgcaaaaatcacttccattattatacaaatccttcgtaagcttcatttttcttaccattgtacttcttcaactttttctcttcttctctccgttcatctagttcatcttcgttaattaggtcatcaatatcgaaatcgaaatcatttggatctttgttgtactgtccaattacacgtcttttaaggcctgtctttgagtctatttcaaattttctggaagcggaagaggcacttgcactgtcatggccaaggctttcctccgtgtccttcagatcaaactttaatacattggtatgatcaagtttttttttcaaatattccctcttaccaagcttaccagtcgctgactgtgc

SEQ ID NO: 15549 - DNA, 436 bp, Saccharomyces cerevisiae
tgtttcaccatcgtcaatagctacctatatttatatacaagattccgtatagtttgtacaccacgtcaggacatcaatagctaataatcgttctaatgctaatgttcaactgctctttaagtattgtttacgtctcgtcgtaccagtatgccaaattcctgtcacttcactcattctctttgctcttaccgtttgaaacgcgctgggacggaattcgctcatttcgcatcgtgctttgttgttttttttttttcaaaattgccattgtttatttataaactacatgaaattattctgtatttatcttcgcattccctctcttacttcaaaagtgagaacagcatattcaaatatatatatctactcagttgaataagacactatagcaagaccatttgaactgaaagaaacagtttctttgctcccctctcgaatt

SEQ ID NO: 15550 - DNA, 401 bp, Saccharomyces cerevisiae
cattgaggcaaataaaatatgaaaaaagcctttattcgtacagatttgctttacatattaaaaatttcaaaaacatataatttaagtatataagtagttaatcatttaattatttttccgtggatcgaagaatttcgttaactttttcatcatctcttgatctattcacaactttaaatgcaaaagtcaaatatgaggtatgggatttgatctcagcttccatctttgtgacctccttccatttataattactatcaccttccttgattcgagaacctttgccaaaaggattaaatttggccttttctgttaatggtacgccatcctcgtttctttttccaactttttcatcgttagaatctattgtattgttaaacatccgcttgcgtctttctacaccc

SEQ ID NO: 15551 - DNA, 481 bp, Saccharomyces cerevisiae
taaactataattaagatttttttttttaacgtttcccgctacacaaacgtatatatctagactcagatgtacgtttataatggctgcttatgcgcttatcgcattttatatacttttagaatcaactgaatcggctatccgcactctattgttttgtttcatgaaaaaaaaaacgccttctgaattccaaagggtgtgaaaattatatatactattagttccagctaatcaatcagaactagtcaacatagaagatagataagagaatacgacaactaaaaatggctccgtcaatgattccgttcactgtatgtttatattttatagtaatttttaaaaagctttagtatgcaaaagatctaggatgtactaactgaagaagggtaaaactatcatccaaattattgttatagatcaagcttaaaacatgcctgaaaatgtgtattcaaaggttaagatatgctcaagaaaagcaacaggc

SEQ ID NO: 15552 - DNA, 410 bp, Saccharomyces cerevisiae
taaggttcactctcgcccccaacctccttatcctttctatatttcaagtatattgtaaaaaaaaaaattccccctactgttatatctctttggtgatatcttatctataatctacttattatatttctctaatatctatgtacaaaaaataaaaaaaaaaaccattctccttctctaacctgcatttgatgaaagcttagtaagtctcatcgtagttgatgggccaaagacatttgtacttgtttcatcagattcttacatcacccatttccatgattatttcacggatttcattagtaattgcatttttgtatccctagttccttttctcccgccttgccgtcgaattgaaaaaaaaaatggaaatgaggacatcttccattgatatccaggacaaagcaagagtagaa

SEQ ID NO: 15553 - DNA, 415 bp, Saccharomyces cerevisiae
tgagcaatcttattggtttaatacatatgtatacacatatacatatctgtacatactcataaatatctggatagttcgtcagccatttcatttgcaaaagcatcagcttcactactattctcgatagacttatattttagccttgcactttgcaaattcctaattatttgttcgaggggcatttcattaggaatttcctcccttattttagtagccggttgaacttcacaatttaaccagtcgtgggtatctataatctcctggatcctatcaagccccaatttttctccatagtcgttatgattaacagttggttttgaccttttccagtttacgaattcgatgacgtttgtaaaggcattgctccatatctcattcagttcatcaatttcatcttgctcgacttcttcgttca

SEQ ID NO: 15554 - DNA, 451 bp, Saccharomyces cerevisiae
tttatacaatttgctaatcaagaagaaccttagctttatgtttgattgctacactctattatttaagatggctgcttttacttaatattcttcgtgataatactgtactggtggagtgtttttcgttttcgaggatttgagagtacgcttcatttgcagttcttcttgataaagttcgttttatatatatatatctattttatatctttatatattttattacacccagttaagttatcgatccaagattttaaatgcccgattagaggaaacttattacctgaaaaaatatcaattagtgattctatgaaaagctattacccgcattctcatagttcggattttcagatccagcaatataagagaaccaaatgtagcagaaacgtcaaatagtaagcaacaggagttacatttgaggtgattttaacttagggaaacatttgctgattca

SEQ ID NO: 15555 - DNA, 432 bp, Saccharomyces cerevisiae
ccattccattaaagaaaaaaacaaaaactaatagtattgttttacatatacaaaagaaaaaaaaaagataagaatacgtactttctatttttatttgaaggtcattttctttatataaaataatatactggaatgatgttctttttgttgctttctatatttgctttctttttttactttttattcaactccagacgttcttaaataactcgttatcatccaatgaaatgttagaactggaatttgaattcatactattattatttgtagcggtaattccagtgttcacgaatggtgacggagtattacaaggctgaggtgtcgtggaagtgaaaaatgagttctggctttgagtctgggcagaaggttttgagtataaagataaaatggattttttcaaatcgttcctttgcccaaattcaccgactctgt

SEQ ID NO: 15556 - DNA, 484 bp, Saccharomyces cerevisiae
actaaaatacatagctttccgtgttatttacaagacttatctatacaaacatttgattgcccgaagtattttaatctcctaaacggcatgtgattgaacacggttcgaggtttataccacttgtattaggcatatatgcaattgcaataactcattttaggttcccgttttaccttatttgctaataccccttttttccaaaaagtccttagcttcgtttatcttagtggccaaaaatggagaaccacctttgtcaggatgattagctaacataattttcctatgaacctctttcaacttttttttagtcaatgtattttctgtcaaattcaaaatctgtagagcctctttagaattcattttcgggtcaaatccgcctttcaagaaggcagtagtggattttccaccgttaagtcccttcgatattgatttatatgcaccggctgtaaaatataaagttaaaaaggccccaaaacctgttatc

SEQ ID NO: 15557 - DNA, 481 bp, Saccharomyces cerevisiae
aacacgagcgagaggataaaataaaactatttacagtatataagattttggtagatccccttctacccgatacctttataattacatatgagggtaagaggctatcgcttcctttcttttcattacttcgatataccagagaatatcctattatttaccactgaccaattcaagttatctagaacattcttcacgtatttggaccggttaccaacgccataatcatgtaaataagcatgatcccacagattgacacagattataggcatggtccagtcttgaaccttaccattcaacttagtagactttcctatcagttctttcatttgtttcaaggtagcaaattcatcgatggatatcgcactgtttaaatcaaatgactggttcctgggaaaataatacggcgtaccattattattgctcgttaatatgaagagttttttctcattgttttcaactagaaataaccagccttgtccca

SEQ ID NO: 15558 - DNA, 461 bp, Saccharomyces cerevisiae
tgaatttgaaaaaggcaaggttattaattaatttttgtgttccgtttcatattaaatatgattaaaatatattgtctatatacaattcagaaaattataatgaagaaaattaaaaggatggagaattgaaaaaatttacggggtgatgttgcatgatcttctttttattattttaccttgcaaagtttttttcagcatcaatggggctttcgtgttcttcaatgattcttgaggtagtagagtcactttcttgaacagctttctcagcttccacgatggcagctccctttctgctgctccaccagcagtatgcaatgcagagaaatacaaggacggcaaatacaaatccagaccacattaggccataaaatggagaagagccagaaataatgacatcgtaattgtccttcttggagccggatttcatcatattaaggatgacgctaaagattgtgcttccc

SEQ ID NO: 15559 - DNA, 437 bp, Saccharomyces cerevisiae
gaggccgtaaggtggttttataaatcagtgtaatcacattgtgtgtactgaaaatcttgataacttaaggtaagttatgtatccacctgatttttttgacctcgaattttaaaaatttatgtgatttctttatgtatgttacttagacgatcttgttatagttttgtaagaaattatacttcctgaaacgatttatcccgctactttttgagcgtatttcacagtaaaatatatactacaactgaacaacgttgttgaactctatgttaaacatcaacgaagaaattcttaagttctatctgctccgagtcatcattcttccaaatttctagtaatttcagacttctttgaacaagctctttattcggcatttgtacttcctcttgctcgtcttgtacctctttttgcttcccttgttcggcattaccgtctttttc

SEQ ID NO: 15560 - DNA, 478 bp, Saccharomyces cerevisiae
ttgggagaaaactttccatacttcaattgtggactgatataagtattttagttttgcccgcatgatcatcccacatggctacagcagttctctcataggaaaatagtacaatagctacgtgatataatctaaataattgttgccaatgtgtaattatatcattttgaacgtacgcgaaatggattattttcaaaaattttgtttcttgaaatgagtaaaagcaaaagtccaactctccaagtcgatgtaaacaactttttgccaaagggactgaaagactaaatcgaggattatcccgttcaaactattccagaaacgctcgttagtaacaaaagacataccttgttgaccaattgatcacatgtttggtttcagcggtagtaataacgggttcggaaataaaccagctggttcgaccggtttttcatttggacaaaacaataacaatacaaatactcaaccttcggcttcaggattt

SEQ ID NO: 15561 - DNA, 488 bp, Saccharomyces cerevisiae
tgcattatgtaaattcctatcaatgattaattatattactctatataggtatgaagtgcggaaataaaagactgttcacatattagattattcaagattacgcgggctctatttttccctgttagccacacgcacacaaggggcatacaaatgttcactccatttataagaggattccacacaagatcatcgataacatggttcagtacgctccctttctattaggaaagtatgttcattcttcatacgctattctatttttttttttttcacacttattcttttactaacgcatagttaaccatttgctgtttcgaagaggcaacatcaaacaagtcgatgtgctctttcccaagctggtctctattgcagattttctgatccgttattggcaattatggtaggctgtctcagctactatgtgtacgaaaggaaaatggggcgtccacaaggtcatcatttacacgagctcataaagaagcgatggg

SEQ ID NO: 15562 - DNA, 424 bp, Saccharomyces cerevisiae
gttaagttgaccaatattttcgaggccaattaaggcgatctgatttagataaaaaacgtatatatgtatttatcaacactttttcgaaaacaaaaagatttttagataggagtatgtacattccaatatatttgtaatgtttcacataaaaggacagtctgagaaaaaatgcaagtaatgtggtaagaaggaaacataagatgacggcaaatgcaaaaatgaggtaagaatcagcaactaatccagagatggcacaatcaagttgtaatactctccaagagcccttttctccgatgcactaaaattaaagaggtctggtaggtgaaccggcatactcgaacctcttggcaaaaaataggtttcatttcttaacgcgtcaaaaaattcgtgagccatcaattgtctagcatcgcacctttcagtg

SEQ ID NO: 15563 - DNA, 496 bp, Saccharomyces cerevisiae
taaactggttgaagtcacattacatataactacttattttatctaagtcctatatagttctgttattcactagtttgtatattgtacctctaatttatcttataatttcgtcagtaatgacttataattggctttattttcttctcttttttttcacatgcgcagaacctatataacgaaaaaaaaaaaaatgaaaactgaagataagcggccttgacttctctaaactgccgatatttcaacgaaagttagccaacttatttataaaagccttgaataccaacaattggaaagaaggtgtctgtgcttatcatatatagcttgcataaagaaaaattataatatcttcgaacttccatagaaagaatatctttcagtgttaactggctcatttactcagaaattagtattttgaagaacgatgagtattcggaatgataatgcttccggtggctatatgcagccggatcaatcttcgaacgcttctatgcacaaa

SEQ ID NO: 15564 - DNA, 400 bp, Saccharomyces cerevisiae
taaaaggtaaaagggcgttaaatgcgcgcttttatgtttgtataaataaaacacgttgatattttgtcttatataaactttattccaataaccgcgacaccttaccaaacacatattattacaacacatttttatcttggattttaagtaattatacaacagttttcattttagaaaatgagaacatcaaatatatacattccaatgtaatagaaaatggaaaagaaaaaagaataaaaagaaaaacacgaggggaccaggttgctagaagatagggtgaccacgtcaaaagaatatacctagggaaccaaacaatgcgaagttaacaacccatcaaagtatttttaatagtgagtggttcaatagaaaattagaagtctgttcatttaagcgcgctaca

SEQ ID NO: 15565 - DNA, 489 bp, Saccharomyces cerevisiae
taatcattggcacctgggcatatttttacaaaattcactcatatagttatacagaacaacagtaaccacttttaatgtacaggtatttctatatctacaaacaaaaatgtgtagttatatatctaatgttgctataccgaggaattataaagtaataaagatgttaaattaaaagacaaaatttttgagaggctattggaaaagaagagaaaactatttcttggaatctagtttattcagtttagctttttgtttggcaatttgcttctttttcttttttaagttctcagcttgttcctcctttttagcattagaatacttcatttttttgtaaagtttcttttgtttgttactcatcattatcattttcaatttcttttcttcttcttcttcatccacctttctctttttgttctttgacttattgacatccttatcagcttctgaagtttcagaatatttgataccttgtgcttccaattcaagctc

SEQ ID NO: 15566 - DNA, 480 bp, Saccharomyces cerevisiae
accaagaagtagtaaaagctcatggcttcttatatattatatatggaatacatttataataaaataataagaattatatattttatgattatattattacataaagtattccccattataaattctgagtttcgtatttaatgatttttcaatgaatatttaaaataataaaatatatgaaatgttcatatacaatgaaattgtcatgaagaaagatgactccaagtatcgtttataaatcgtcgagaaaaagattatgaagttggttaactttttaaaaaagctgcgcaatgagcaggttaccatagaactaaaaaacggtaccaccgtttggggtacactgcagtcggtatcaccacaaatgaatgctatcttaactgacgtgaagttgaccctaccacaaccccgactaaataaattgaacagtaatggtattgcgatggctagtctgtacttgactggaggacagcaacctactgc

SEQ ID NO: 15567 - DNA, 421 bp, Saccharomyces cerevisiae
ttcaatatattttgcagcttgttcaaaattaaatgctaaaagtagagtaaatccgttgaacatacatagttttgtaatgtcattaagggtatcttcagagttgttatcgtctactatgaatatcagtatattattttcgtttctagataagggctgcattctcctagagatataatcgacatataatttgtgataagtcaaagttaagaacagtacacttcttccacgaactagatagtcgtagtatatcatattaattcctgttgaagatacatatctccaattggtgctctttaagtggttcaggagtggattttctttttgggtagtgttcactagtacagtttttcccggtcgagtactcctgaagggtctctttcgattatagtcatctgtagcctttgagtcggtccattcttcc

SEQ ID NO: 15568 - DNA, 445 bp, Saccharomyces cerevisiae
tgttatttttggatttttcatgaatagccggagccagtagctggaagagctgtgtcttgaaataattctttacaatacatatgcacataccataaagtacaaatatataaacgcctttaattagaatattgggcttgaaggttatcttactattttcgctgttcatcgacaactgtcaattgctcctatttcttgttccaagagaaagcgtttttatcattggtcgcctggacattcctctccaatcacttttagccgcttaggatgaaaaagttgacaaaaaaagaccttacgaagcaaaaatgaataatagctacccatatacataatgtataagatgctgtaataaataagaggatgaattttataattggtcgttagagagaagaaaaaaatttatagaattgatatataataagcagttgaaaataaaagttcataccca

SEQ ID NO: 15569 - DNA, 488 bp, Saccharomyces cerevisiae
gttaaaattagagaaattcattgtccatcaaaatgtttttttttttttttaatattacaacttatttccgtaaataaagatagtacacacgaatccaaacgtttatatagttagctctgtgaaaatttgatttaggttcatctcttggtgtgtttggtagaggtggtttcacacccttctcttctgtcttgccttctaatgaataactgagtattctttacatactttgtttttattaaccactagtttgaatatatattcgactgaaaggcaatatcaactattcaatctttaacatttttctcgagccctcattgtccacattttcactggatttgttttcatcttcaattgcatgctttttgggcgatattacactttgcactgaattgctatttatgtttgataaccttaacggcattttcttacttagatttggtatttccttcaatatgttctcgatcatttcgtctttggtagcgttttcc

SEQ ID NO: 15570 - DNA, 452 bp, Saccharomyces cerevisiae
tctgaacattttaactagcgggaacggcatatgtacggaacttttatgtatgtttttaaaaaatttcctttctatccttattacattaagatttttaagcgatagtaggatcggaaatataagcactcgtttatgatataaataggtcaagaatttcgtaaagtaaaatcaatacatatgtgaatctttttttttttttttttgggactgctattggtatttttttagcgtcacgttaatcagcccaattatgtgggggttatgcaagaagcattttccgagcaataaaattcaagtgcaggagagaaacaaagcattaaaaccaaagaagagtggcagcgaacataagacaaagcaactgtttcctgtattcaattgcaagaagaaggaaaaaggggtaatgatacggtttgcgattctacgtaatgctaacacatctctactgtccgcga

SEQ ID NO: 15571 - DNA, 408 bp, Saccharomyces cerevisiae
ggcgaatagtgagaatcggtttatactaatagtacaacggtaatgttatataacagtttttacatacgccattgtatgtatatatatatatatgcatgatgagttatttaattgtatactcaaaggcccccgaagtgcgaaattgttgtagcttagttttattttattcccttttcgtccaagaaaagctacaaagatggagttgggtcaactacttgccagcgaaggtggtctcgcagtttcttattctatgtggattctggagcaaataaacgtcttcttactctcctttttgagctattttccgggggcttattagtgggagtagaggtaatattggaggtattttttctgccttcatgcgtatcatcatccttgaaatttagcggcgattcaatgatgctttga

SEQ ID NO: 15572 - DNA, 411 bp, Saccharomyces cerevisiae
gaaagagatcaaaactgcgaactctctccactcccagtctgtgcttctacgcattcattgaaaatggaaagaggacgaaagtgtgcaaaaaattagccaacttccctttatataaatatcgtatacacatacatacattccttctatactaatcgctcttggatacactaaaacaaatccctaatgcaaacatacatgttattatgccatacaaagtaaacacgcaagtatataaacgtataaatggatatatagatatctctacgcatattctttacattatcatagcatgaacctttttccctttttctgctttgtctaatttatagtattagttatgctctagtgctctaatggaaaaactcgttaaccgttatgcttggactttttggaggatttgaggcagtagcg

SEQ ID NO: 15573 - DNA, 444 bp, Saccharomyces cerevisiae
gaattttcttcagtaatgattcagcttttatccaccctatttgacaaaacaagactacgagcaaacgaacgcgagaattgccttgttttgaataaattcctgccatcggataacgtccacggtactttttgattcaagtttctatagaagcacgtatatatctttaatacactaaatacttacttccacagaacgaggtatgtttttcaattcatggttctttttattttggtgttatatacatgtatacaagacggaaatggcttgctttgtggctacatatcctttagcaatacgccaatgacttccgctaaatgctggattggaacagtatgtttctcaattccatgttcatttttggtacacttccattgcagttcgctacatcttttttcaaactgctttctccacaggtccttttctccccatcttatgccacgaact

SEQ ID NO: 15574 - DNA, 458 bp, Saccharomyces cerevisiae
aaattgttctactgtgcactcgtattttctgaattcaaaacgataggtttcctataagttttttgatgataatttgattaattctatgtatacataatatatctattgctttcttttcctttattttcaatattatacaagggaatggaaaaataatgctctttgttactactttttcttgtgatgcttctttgcgatacgtcttagggctctttgttcattcttcatgacaccatcaaccatcttatacttacccttaacgccctttggtctacctgccaaacctttgttcctacctgaggcaacaaccaaagtaacctttggcttggtctttggttttttggtaaccttacgcatcaatctagaaatttcttcagccttgtccttctctgtcttgtctgaatcatcgttaatcaagcccgccttcttcttgatcttttctaaccgagctacggcac

SEQ ID NO: 15575 - DNA, 404 bp, Saccharomyces cerevisiae
tctgcaaaataaataaggattatcttattctaaaattctattttatatatgaggcataaatctatataactttttcgatgcagataaaacattttactattgccaagcgaaattaggttctcattttcttcattcggtgcctaataattgcaactttgttcggtgatccttctatgtgcatgcgtcataataacttaactggaaaaaactttctcaacttacgacaaaaaactccgatacggggagtcgaaccccggtctccacggtgaaagcgtgatgtgatagccgttacactatatcggacaataattgttggaaaaattccattacaaaggtaaattactatatggaaaaacttttacaccgtataaccaatcatattcgcgagaaattaggccaatatg

SEQ ID NO: 15576 - DNA, 412 bp, Saccharomyces cerevisiae
tatttttctagtatgactgtatttatagtactatatagattattccatttaaacaaatgatgattgccaactatagtagccaaataacgaagtgcattacttaacacatcttatttttatctactgaagatatcgccaaattacagcacatgctaaaaagaagatgtttagggtcctttacataactatacgttaaattatttttgctgctgaaaataaggaaaataaaaacaaagataaaaatagaaagaatgggaaaatttagtaacagcttttgcccaatatgctcaaaaccgagttatctattacaaagcgttccttttatagaaaaaactgacaatcaaatgtagtaattggctattgttaacaacaacgttggaatggaataatttccacgtctcgatttttggtt

SEQ ID NO: 15577 - DNA, 456 bp, Saccharomyces cerevisiae
atgcaatcctgaatttgtcataatgacaattacataaccccttttatatacataaatatttgggtcagcacaaatttattttgattttccattattttagcagcaacaaggttgaaaaaatcgccggcgcatcaccaacttgaaggacaaagataaccttacttgaaatcaaataagtgatgaatacgacagcggaaaaggttatacgctttgctcattatgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgttta

SEQ ID NO: 15578 - DNA, 416 bp, Saccharomyces cerevisiae
cagtagagagattactttacatagagtagataattccatatacttttcataaacaaaaacgagcagatcctttagacagaatatcaagttctttcacaagccaaagaaacttggcatgatcagtactggtgcaattcaaataactgcaagtactgaatctccatcttcaaagcagaaccgtaataatgcgtacaaggaagcgggtgggatatatcatatgttacgggaaagtggttgtttgactgaagatcatcgagaacgtcataacttcaatacataagtcatcgcgtaattttacaagctttactgttcagctttataggataatcagaataagaaaaggcagataaatagtttgataaatggccagttgtgatggggaaaaagacttttagagaatggcaatatttcaagtt

SEQ ID NO: 15579 - DNA, 442 bp, Saccharomyces cerevisiae
catgggtttcccagtatccatatgtttatgcatatatacatatatatgttgatttagtgtattttccactacataaaaactaaaaaacattcaaaatgaaaagtcaggacccttttcaaaaaggatcgcaattatactattttaaaagtttaaaagcgtttctctttaatgcgtaggatactccgctcattattgtggtcgtggcggttacataccctaaatagctaaaggccttttgaaagtcctgttttctatcttcgaaatcctcctcggttttttcacagccctcttctttctcatataaaagtaataatactccagatccaagatataccatttggaaaaacgtgttccattttgatagttgggaaggtctgacctcagcgctgggatagcgaacaatatcccaataggaattccatgccacacgaccaggatattt

SEQ ID NO: 15580 - DNA, 406 bp, Saccharomyces cerevisiae
ccgtgatatcttccgtataatttcagataacaaagatcatgccatccaggataagcgtatgcatggttaaatttttagactatagaacaagatttttctgtatagttatgtttatagtatttaagctttctaacaagctccagtaggggcggaggatacaaacaaatatattttgctgcaaaatttcctggtcttccgtcgcaatcaacaagttgatacgcagatgcaccattttattcattggcaaagtacgatcagtttagtgcttgtatctgtatgcgaaaaaagaatggtgtactaaaaacagcgcatggtgatggcgaggaatttacacgtatcctctcattaattgaagtattaggttttcgagtcgcacttagtgtaaatgaggtgtagaaaggtgggg

SEQ ID NO: 15581 - DNA, 410 bp, Saccharomyces cerevisiae
tcacaaggcaaagcggatagaagaaaattttagctggtcttatatggtatatatgcagtgtcttactttctcccttccatatatatgtatctacttatatatataagtatatgttgctcatttagaaatgattgtcacctcatgctaatcattttattcttctcgttggtctgtgatgaaaaataatgaaaaaattataattgctgtctattttcttttcatctcatatgatttagcgtttttttttgcccttcttcgaagagttaccaccgttcttggtggatttctgcccagcgattgttacttttaacttgtcgacacagagcagaagaaccaagtcctgttccttcaagcctttaatcatttcatgttcttggggccaatccatttcgttgtcagttgaagaaccg

SEQ ID NO: 15582 - DNA, 457 bp, Saccharomyces cerevisiae
tgttaatgcagcaaagtaactagaaaaggatctttattgttttttccgatttttttaactcactttggatacattttttttaatatcttctctgtatagttaaaaaaagattataatataatataactgaaaatttttatgaatatgtgtatgtttacgaatatatgtatgcatgaatggggacatgccagcgcgtattcacgcattagtctcctaaaccctctaagtgaaatatatgtatgtttattattctccatccataaagtctaccaagatcaaagaagaccgcaaatattgtacataggcttttcaataatatatatttgcttcaaaccaaagctgtcctcttttttatttcttcctgtcggcgaattttttgtaatcttttctttgattcaaactctgcaaaggctttaacgtagacaggaatatcttcccagccttcatcagcatctga

SEQ ID NO: 15583 - DNA, 410 bp, Saccharomyces cerevisiae
ctttgattttgaatttaggagcacccaggagattttattttattcttttcatacaggtcagcataagcctaagaaagacgtttgaaatcgctaatcggctttttgttcctacgagtaggttaaattctttcaataatatacataataaattagtagtaaagataaacttttgttcgcgatgcagttcttttggttgtgaatagtttttttacgaatttatactagtcactgctagataagggttaaggaggtaaataaaatacgacaaccactttaaataggtttcaaaactatccttcaacagataaaagggtttaccgtcagaatcattgaaatcttttaaagggtgtgaaactatttttatcttcctctgtcaccgtccaaagcaaccgagcaatgcagtgtttttc

SEQ ID NO: 15584 - DNA, 447 bp, Saccharomyces cerevisiae
atatttgtatattattagatatgtatgcaaacattttctttagaataatatactattcttgtacgatgcagaattttttttttttttcgctttaggaaaatgacgttttgtgccgtggaaaaccctggaaaaggatattggaaaaaagttaaagcatggtcatttagggaagactttccttccaatttacttatcaataggttataatgtatgcttgacggagcagaattctttcaaaccataagataatagatattataacattttagtacataaaagaggcccgagaaaatagattttaactggaataattttttgcaagatgacaacaaccgtacctaaagtgtttgcattccatgaatttgcaggagtagctgaggcagttgccgatcatgttattcacgcacaaaactctgcccttaagaagggcaaagtctcaaggtccac

SEQ ID NO: 15585 - DNA, 494 bp, Saccharomyces cerevisiae
cagaatgtgtgaagagatgtttatcatatgtcactatttctccttgttcttcttaacaattctatatttaattacaatattttaatacttaattttttctacttcaattacctttaagttctatctttattaaattgtttattttgtttttatacattctgtgcagattaacaatatgctatttattaaatgactattcaaacctcgaattgatattctttcttgaataccatccaacaaacgccctaattccttccctcacctttctgtaatcctttgaattcaacccctcaaccacggccttcgccaaattatctctttcattaagggttacttggccaagttgttccaccactttgtaaatccaatcgatgcaaatagtggcatcgttgttgtttgcctctgtcaatatccttaaacattttacaatacaactgatggcatctgaatgagcggtgttttcaaaagtagtaaccagcccgatgaataacact

SEQ ID NO: 15586 - DNA, 487 bp, Saccharomyces cerevisiae
ccttagtgttgttgctattattgctatgtaattactattcgatgcaatatgttatacatatacatacacgcaatgagaaccctaaccttgaacttactattttaaaaggacatctcgaaaaagcttagggataattaatattttgtaggttagagctgttatgtagggaagaaaaacaagggctttaaaataataatcacattacacgaataacttaatttgtctttctgaaatggaaaaagaaaaaaatgacgactgtaacattggatgaattaatactgtcattattgatacgttgttaattatagacagaaatgtattcagtacaatagaacagtgctcataatagtataaagggtcacaatgtccaaaaaacaggaatatattgcaccaataaaataccaaaacagcttgcctgtgccacaattacctcctaaacttctggtttaccccgagtctccggagacgaatgcagactcctcccaac

SEQ ID NO: 15587 - DNA, 482 bp, Saccharomyces cerevisiae
aaagtctgaataatagaatgagttacatacgtaaacgtgtagtattattattattattctatttcctttccgtttttattatttatatatatatatatatatatatatatttgggtgtttatatttaggtagggcataaggatttactgtcggcatgaacctacttgaacaaaaaaataaaaatcaaaagaaaaataatgtaggcttttgcacatcgactatatataaatatatatatacacacttctgtgcagaagaaaaggaataaaacgtcaaactaatttatttcttcttgcaacgattccgacttctcctttaaacgtgcaatttcgtcatcgatgtcctgaattttcttcaatagttcaaaatttttctcatcgccgtggtcatccttggaagcgccggattgagcagcagcttcggcagtaacagagtcgttcttcttgacatcgctggaggctactggaggcgatgctctgtat

SEQ ID NO: 15588 - DNA, 405 bp, Saccharomyces cerevisiae
gaactatgaacgctcgtaagtaaatattgatttatacatgtataagtttttcaagatttaaggaaaaaagaaaagttattatctttctccgcggtttttcaatgacccgatgtattgactcttcctgaccgaaaataacaggacagagttagaacgaacatgaataataaaatataatctgggatcatgaatccgaatgactgctcatgcggcaaatgtcagagcttcggtgtatttaaagtttgcttacttacaatttcaataataggtttgtacttttcagattcttattattaagtcaaggtaaagtccttcgtttttttttttttcattttagaaaaatttcaacagccaccgtacaattttattcacttttaagtcatagttgcgaagacatcgtcttga

SEQ ID NO: 15589 - DNA, 500 bp, Saccharomyces cerevisiae
acatttgtatcgctattctttctttcacagtttaaggatgtatataaatgtagtatatatcattttatattctaatatgcaagaattttcagtctcttctttttccttagcgtgcgtttatgaaaaaaaatggaatatgaataattactgggaggaagaccaggggcaaggggtgaaccatcttgtcatctgaaatcttgtataaataatttagtaatcagttctttaggttttcgagagtggcatacaacctaaagggtcaacagacaacaagaaggaaaggaattataggagcaaatacacgcccttcaaatggatccctttcacaatggcaataaaaggagctcaatatcgtttggctcatcgcagcggcagccatataacaagaacaattacttgagtggtactaatgggccttcctcggcggcacaagatcaaggtagaggcccatctccctttggaatgtctggcaacactaccaatggcggtaacagcaaaag

SEQ ID NO: 15590 - DNA, 485 bp, Saccharomyces cerevisiae
gtattaacttttttttactcgcttctagaagtttagtatattcttttgtacacagaattgtatattttttttataatcttggattcaccatttaactagatttggaaatataaggaatggcactgaaaaaattaaggaccaaccccgaagagcaaaaaatgaatgcgaattctgtggatcgaacacaggacctccagataacttgaccgaagttttttcttcagtctggcgctctcccaactgagctaaatccgcttctatttatgaaaaattcattgttacaggaactataggactataataactagctgctaacacctttaaatgtgacttttctcataaggaaatctagcgattcagaattcgagaattttgcagattgcaaagttttctttttaccataatatttgagaatgttgtaaaacttgagataattattcggatgtcattgttgattgaagatagcattcctatgagtcgccctc

SEQ ID NO: 15591 - DNA, 429 bp, Saccharomyces cerevisiae
tgagcaaccactgatattgtgatcggcctctacgtatgtagcccataacacaaatagataagtataaggatgtacatactttcattgtttcgtcaattgttgtttgtattgtatatgattgtacttctgttaagtatataatatgcagattgtatttgtgcctcaatgtgcgccattcatgtgttgcaaaccggtaatttgattcaaaaaattctttcgtaaaataaaacatatgcactgggtgtgataaattcagtactaaacgttataggacgataaagcgagtcatcgaaaaaataccaacctttttttggtcccttataaacgtatgaagtatagtgtcccccatacaaactccccgaatgacatgcaaccccatacagtctgtatctaaatggtggtacttggcccctggtaggaatgtcctca

SEQ ID NO: 15592 - DNA, 435 bp, Saccharomyces cerevisiae
gcacagaggtgagatgcccaagtgagaattttttttaaataatgatgtactttaatacaatatatatatatatatatatatatatatatatatatatataaggaatgataactctatttaagtagattatgacattgtagtagaagagggcgtgctacttgcgctctgtttcttcttagtcattcttttctttttaggagctggtgtaccgctctcgcttttttttgcattttttctaggtcgcttaacctttggtttatctaaattattattattattattattgttactggtggcattgttaccactccgtttatttgcgtttttcatggctccaccattctgttgttgctccaaggcctgctgttgtctttgaagtagctgttgctgtggagtcaatggtgctgtcatcgatattctagcgttgaagggggt

SEQ ID NO: 15593 - DNA, 470 bp, Saccharomyces cerevisiae
catatgtagtatttacccaagtagtggtgtcaaaatttttgtacccatacaatatatttttataagaaaagagcaaccgcttgacatttattaacttaaatatgttacaagtaagcgtttttttattctttgatatattagcgaaggaaatttttcaatttaagcctgagattctcggaagttgttgtagtttcgagatccaaatcccaagataaaaactttttcactatttcctgattcttttggaattctctcatctccttttcggtcagatttccacattgctgaactacgtcatcgcctctattaatcatgcgagatagttcttcagccctttccacaatatctctgctcaaaccacatacttttgcgcaatatatgccaaatgactgctttgagatcccctcctttactttgaataggaatgtgattccctcactttcatgatcttctccgacatgtgctgtttc

SEQ ID NO: 15594 - DNA, 436 bp, Saccharomyces cerevisiae
tagaataatgtaaattgcacaatggcaggggccgatttccaatactaatattagtttcgaaaatcggaagaaaaaactatatacatttgctactttaagtatatatgattatgcagaaatggacatatgaactaaattatgtctagtaacacctcagtgtaaaatgcttttctttctcttcttctttggttgtaaagaggctaacttctcctccctgaacgactcttgaatatctttttcaatacagcgtgctttgttaaggttattcatgtttaccgcaagaatattcaaaatctccttgtcgtcaatcacaatcttcgtgttgtttgcttgcgtctcagtagtttcaaggcgatccttgtacttttcttgacttaccttttcttgaaatctttcttcgatccatttagacttcgtttctgattctccttcccca

SEQ ID NO: 15595 - DNA, 416 bp, Saccharomyces cerevisiae
tccaaagtttagttttatcctcaaataaacatataagttttgagcggatatttcagaatgtcaatttttaaaagtaaaaggagaaaaaatttatataattcacgattaacattatataatgtgatgaactacttaaaaaatttaacgttcgataattaagtaacaacagagaaaatatgagcttacctaaactctaatcattaccgtctgttttatttactgtcaccttgatgagcgactaaaaagatagaacgcgggtttttcgcgcaatgtaacaaagctccagaaattttttataaatactaatgttatagcaaaaaaaataaggaccttaaagtcgtaaactaaattgaaaagcccaaatcattcaaattctatatcgttgaacttttaataggctgcgaataccgactatg

SEQ ID NO: 15596 - DNA, 424 bp, Saccharomyces cerevisiae
caatttgaaatatagtcatccctgcaaggttttataaagaaaaaagtgatgatattcttttaactaatatatacatatataagaaaagaagccttaatttctcacggacaaatataccagaagcatatctgaaagccgccccaatgcattatgatgccacttgacaactcatcaatggtaggtacgaaagacataatgaacatcaattccattatcaaaaacccttccaacctcttccagtgacaaacctttgacttctggataccaaaaatatacgaaaaaccaggcacaaactgtgaaaaaagcaaaaatgagcattgtattttcatcaccaatggtgttaatagtgctcagatatgtcattgaaacaaatgcattggtcaaccaatttgtgcaggctatacatgatgccccaaatgatctc

SEQ ID NO: 15597 - DNA, 461 bp, Saccharomyces cerevisiae
tcagtcctcgcaatattttcattatgtcaatatatatatgtttactctccttttttctttttggtttttttttttttttgataaatactccatagaacactaaataaattgttcaactgtgttattgtctttattcatgttggttttcaagagcttggatttttgaatcgtcttatactatgacgttcactattttcgcgaagccgggtaataccattagctattttgatagaaagggatttttattagggaatataaaccacctttatagtgtcctatcatgtttcaatctccagtaaacgcacataagccgaccaattgagtcaaccttttaactctatttaatttgatacggatagaatattgtgactaccaaaagggaaaaggcagaaaaaaggaaaattaagaacagttaaatgttagagtctttagctgctaatttgctaaaccgattgctaggc

SEQ ID NO: 15598 - DNA, 458 bp, Saccharomyces cerevisiae
tacaagaaataagacaattgagctgcttcattatatatcttgatataatcacctttcttatcgtcagaaagagtgttctctatgtttttctgcttccataaatatatagttcaaaaagtaatatcatatactattaataataaaagttatactgaatatattgattagttctattaattactattgacacactttgaattcccttaaattaaccctcaggaagaaggggtccttaggaaaatttttcttttttcaatataaaagcgaggaacaatggatgggaacaaaaccatgttcagcctttcaacaattggtagaagaagccaaaaaaaaaaaaaaaacagaaacgccaaccatgcacttttctttgaagcaattggctgtcgctgcgttttacgctaccaatttaggctctgcctatgtcattcctcaattcttccaggaagcctttcaacaag

SEQ ID NO: 15599 - DNA, 484 bp, Saccharomyces cerevisiae
gtatctgattttcctttttcacccttcacgtaaacctgaaatatatttcatgtaatatatatagttcatccttaaagaaaacataccatttcaaaatgccctttcccagtagctaatacatgcttaaaaatgtgatatatattattaccatcaaatgtattcatgatccgggtagtgcctttttttccttcaaacactaatgggatgggaagaaacatttcgaaaaaagttatgactattggcagcatcagagagaattaaaccttacctgtacaacgatagcagcttacatcacttcctcgcagtcatggaaaaaaatacggcaccatttgtcgtcgatacggcacccacaactcctccagataaacttgtagcaccttctatagaggaagtaaatagtaatcccaacgaattaagagctcttagagggcagggtagatattttggcgtaagcgatgatgacaaggatgccattaaagaggca

SEQ ID NO: 15600 - DNA, 483 bp, Saccharomyces cerevisiae
gctccctaataacagaatcgcagtcatccttgtatcttttttatatataatgtctaggtattaggaaaataaaatttttgtttattggtattattattataatctattatattatatttgtttaatttcttttatgaagtgaatgggggttgtacacggaaagcaacaatagcacttgtttccgcagacagcttttaaattgccttccatcattactgtaaatgttcgtcctcatatatgatatatattgtaagcggacgtgaaacctcaactcaagtgcttcatttactgtcacggactactttcatcaactttctattttctttgatatattgatcacttaaaacgaacttcgaaattttttcaagctcatcgcaatttttttttgcttgtctaaattttaaactgttatattgaaggtagatagcttgaggcactttattaagaaaacagtcgacatatcatccaccagattatcacgct

SEQ ID NO: 15601 - DNA, 424 bp, Saccharomyces cerevisiae
tcttgaagccaataggataataccaaatgcattaatatcgtccaactgttctatatacttatcgtaacctcgttccatgtgacattcttttttattacacttttcgacaatagcgaattgagtgaaatattatgaaagaatatatagtataaatatatacatttatatatgaattctaatcaataaaagtcacagtaaccagcttttcctagcttttcgaagtttcggaagtatgacaaaatatgagcgtgaccctgaattggtgaactttctatcgaaagtggaggatttgaactctaagagatacagtaatattcctagttcaaaaccagcgggggaagcgctttcaccagttagaagtcacaactctggggaatacagaagggctgatatgatgacagggaaaaatgtggaaggttgcgac

SEQ ID NO: 15602 - DNA, 500 bp, Saccharomyces cerevisiae
ctgaatgtgaagaaaaagatcaactaaataagtttattcagataaatcttcattatctgatccattatttttaagtttttcttttaatgtatataagaaattctaatcttttaattcgcacaatagtattttcatgtactagttcgtacagtattctctttctctggggtttttcccttttatagaagttgacttgttctatagttgttatatatgtattgctgggttttttaatctattttgcggaagacgccaaaaataagaaaaaaattggaaagacacaagaaaaaagtaagaatatccacagctgaaagatctaacaggcgtatttttattttcgaagaaacgtcctaaaaggatctgattcagcacattgataatagcataggcatttttatctttcttttttgagttcatgaatgaatgtaacttctccaaaagatgggaatcacagtttctcgaagaaaaatagatttaatacaaataaaccgcgattccac

SEQ ID NO: 15603 - DNA, 403 bp, Saccharomyces cerevisiae
gatcattctaggacattagtaattggaaaagaaaatgcaaaaaaatatccagtagaaacaatgcttggtatgtcgttcttcttactttcttcagtaatgagttggtagttttctctatttaaatatgaataaatcaatatgtactttctttctttaatcaaaatgttaatatgataaaaatacagcatccaaagcagttaatcaagacttaaatataaaaaatttacatatttagaaaacaaagatagggtaaatattgaaattacatagtaaaccataccttaaaagcagaaatactgataccacatgaactattgatcaatactactgctattctcttcctaatgcaaagagcttattaccattattaaatcactacagacgataatacccggaatgccct

SEQ ID NO: 15604 - DNA, 450 bp, Saccharomyces cerevisiae
tgaaatgaggctgaaacggtttgaataattaggaaagtatgtttttaataaagaaattctatgttcaggaattttgtatatactttgtaatgaatgagaacttagttggcttcaaactttttcgtttaacatgattatttttcttgttcgactaagatattcccacatggacaagtgccacagattaatatatgaatacaataaaataactagtgtaatttgaaaataaaagttgatgagagggacagggacttgagtcctattcaaagtgaaatattttagttatgagttttctttccaaactttcccaaatacgaaaatcaacgactgcatcaaaagcccaagtgcaagatccattacccaagaagaatgacgaagagtattccttgttacccaaaaattacataagagacgaagatcctgcagtaaaaagattgaaggagctgaggc

SEQ ID NO: 15605 - DNA, 460 bp, Saccharomyces cerevisiae
ttgtgactggtgcatctatgtatccaagatagtaattatctgtataatcttctattctttataccttattacccgaaaggcttttctttttattttttattttttttcacttcttgaccgtggaagaatgactaattttactatttgtcatataagaatcatcgagattcttacactttttatggactgtaaacatcgattgctccaaaaagggacatagcacaccgacagaccatgtcagaacaactcagacaaacatttgctaacgctaaaaaagaaaacaggaacgccttggtcacatttatgaccgcaggttacccaacagtcaaagacactgtccctattctcaagggtttccaggatggtggtgtagatatcatcgaattgggtatgcccttctctgatccaattgcagatggtcctacaattcaattatctaatactgtggctttgcaaaacg

SEQ ID NO: 15606 - DNA, 439 bp, Saccharomyces cerevisiae
ctttttctgttcactaaccacaaacgaactgaacgccttcctccgtttagtgacaaaatagagtacttttgatcttagatagtatgtacctagatgtgtatatatgaaaaaaattctttatatttgtttagatatcaaccggtaacctcttgaatgttaattcaaggtggggaatggtaaccttctgtgcattctagttactagttcaagataattgggctcattttctggagtgatgtagccatgtctaatcaagaaatctaccattaccaatgcacaatttggtttgaactctttttttcttaaagcattaatcgtctcttgcaggctgaataaattgaaactctcgacttcaccatcgtttggttttggaatgatgtcttcgctgagttttagatcgtatacatattgtacttcccctacgataaaatctgattcc

SEQ ID NO: 15607 - DNA, 436 bp, Saccharomyces cerevisiae
accgcggtactctcacaatgttttttatgcctttattctttccgttcctatccaaacaaataaataaatttaacttaaccaagcaagtgtgtagtgtttttatatcctatgtaagtcttcaaactttttttttatctctggtaacctttattcgcatacaacgccaatgaaacaaacctgtaataatttttcatagttaacccattgatgatacttattaaaatatgtaatcaaatcgtcactattacggtgctttattaagatgtccgtaccacctggatggaacttcaaataactagaaatgtcatagactttgccgtttataacgcaccataactcgtcctcacctttacaatgcttctttacgatttttctgtttattcttaagggtggcattattttataaaggggtatcttttggacaagcaattggttc

SEQ ID NO: 15608 - DNA, 455 bp, Saccharomyces cerevisiae
ggctaaaagggaatcaatgataaaaagaaactgtatatttttgttggttgcatttttgctttccaattatattatgtatattgaacagttactttaatttttacttctatatttcttttctattttcatccatgttataaataaaagatacagtaaaagacttatggattaacttaaggaaatgaagttgaaacaaattatactaactatcggatagctttatttgtttcaatgcatataatcgacctttttaagccagagttaactttaaacctttcagaatgaattggtagatgttcggagtttattttgtcgtccaaataagcttcaaattcagtgatgctaccaccgactccaaaataaatatcctttgcggctacgtaagttttgacatcggtttgtggtaaattgtgtatgtcaagtattgtttccgctataacgggcaaattgtcagg

SEQ ID NO: 15609 - DNA, 404 bp, Saccharomyces cerevisiae
tgaactatagaactgacatggaccatttgattatcattgtttgtataggaaagaataaatttttcttgtattcttttttaatcagtatacgtaaatagctttttattgttggagttacgtgagttctcgcatagtaattcatcaactattagtgtcttttaaggtttcttacttttctttttgtcatgcttcacttgagaggatttctactactttccataatttttcactaaaatatttttcttctacaaaataaacaaaaaggcctttcgtgtttgaagattactcagatgcaagaatcacactcaagtttagccataaagggtgaaaatattgatgtgtcggcggttttttctctctagacatttaacagttgcattataaaactgtgctgatttcgggac

SEQ ID NO: 15610 - DNA, 441 bp, Saccharomyces cerevisiae
cttgcacatatgtatgcctgtttttctttatcctatggaacactatattttccggggctttcttacaaaacggaagaaaaagaaaaggaaactcagcaagtactatgtacaagaatatatatatatgtatattgtatatatacatcaacttctatacttcgagggaaaacattaacaagagaacaagtacaagccacgtggttatacgtatcagaataatgctacgtatgtcaacttcaagattcattgggcaaaggctgttcactacggcacgatctctccaggctgctaaaccggcaccaaaaggtaaaactcaaggattttccaaaaaatcatcttcagtctcatcttactcatctgcaaagagagttactcctggttcattgtataaaaactggacaaacaccacgcacaccgctcaattacaacagaccgccgttc

SEQ ID NO: 15611 - DNA, 426 bp, Saccharomyces cerevisiae
agaaataaaattaacaagatgatataataataagtggaggataaaacgtaggacttctggtgaattatttgaaccaaagtgtcgtatattaggctctttttctttttcttttaccagacttggtttttttctctctttagtaattgtttctatatatggcttatcaattctatatattttttaacttgaatatatgaatgacatctttaataatcacatctcggcaaacgactgatgagttccacctgcttattgtttatttcctttcgtacacgccgcgcttggccagtccttccaagaatgtaggcagaagaaatcaaactaacttgtaagagaaagaataaaattcattatacatataggtaaaataatataaatacaacggctccatgtgtaagttggaaataaaaacagttggcgtcaagg

SEQ ID NO: 15612 - DNA, 498 bp, Saccharomyces cerevisiae
gaaaacttgtgatctacttttgttttttgttttctttttcttttccccaacacgctggtctttgttccttgttcttgagcaaatcaaacgctcatgggcaaacgaaactaaaataagaaccatttatacaaatacaatagcttagactatacatctgtatacttttcccttgaagatgtttttgttctttaccgtttgcgtgctgatttatgatgtttttacattgggcgttattacccgagcggcgttttgttcgtgggactcacacttgtgcctgctcccatgttaagttttgcacggtttatcacatggacaaaggcattctcatattacacagctacatgtgatatatatcgggcgtttccacgtgtacaagaacctgaaaagtttatcggaagactaagttttgggttgcccaccgtctgtgcatctacgtgaacacaccagggtttctcatttcttttttctttaagttttttttctcttcccttcccttcc

SEQ ID NO: 15613 - DNA, 437 bp, Saccharomyces cerevisiae
tgattatgccattattatatttattaatctatttttctcttttatttacaaatgaaaagtacttaactatatacagcttggtataattttaaaatggtaataacaataatatgcaatgctaacggcgcaaaaaagcctgatatgcctcttggttgatttgaatattacctacagttttcatatgctttttaccctctttctgtttcgccaaaagttttttccttcgtgagacatcagaagcatgcagcttttggagaacatcttttcttcttgccttaattgtttctctagctattatcttgttattagctcgggcctgtataacgacctcatataattgtgatttaacatactctttaaacttcttcacccattctctacccactctctctacttccgatttatgaagtactcttgacaaggcatcaatcgcattt

SEQ ID NO: 15614 - DNA, 432 bp, Saccharomyces cerevisiae
cagaagagatgaaggtgatatataggtagacagtgtattttgtagcagcaggtattacgatagaagtatgtaatagctttcatagtgtaatcgaagatgccagtagtcaatcatgaggatagtgaatttcacctttcgcacacagaagaggacaagttaaatgagttccaggtcatcacgaatttccccccagaagacttgccagatgtggtgagactgttgaggaaccatggttggcagttagaaccagcattgagccgatatttcgatggagagtggaaaggcgaaccagaccagatgggagagcccactcaaacgtctacacccatggctgagaccttggttcctcccgcgttgggacctagaccgttgttatttacagcctcactgcccgtggtcagaccattgccagcgaacttccgcaatgatttc

SEQ ID NO: 15615 - DNA, 493 bp, Saccharomyces cerevisiae
agcgggaactttatggaaaactgggtaaccgaaagaactttttctataatgttacaattaaacttttttaacttaccttgcttcgccttttcgccgaaagtaggtagattgtatcacctcggtatttttttatgtacacaacctatactttaaatatatttagactatgtatgaattctctgtatcaccttcaatgtcaatatagaaactggtaagtgcaatagtaccaataatgattataattataatacaagtatatatatatatctatatatagtggtaaagtattctttacatgatggcacaacgctgagatttatccgtacctgcagaaccactgtttttatgattcttaaacctattcatctggaatttccaacgctttctatccttgttagtggcatgagtagggttatctatgccgcttaaagactttagtaatgtaggtaaaggcaaacttttggacctttccacggcactcatagcattgatg

SEQ ID NO: 15616 - DNA, 466 bp, Saccharomyces cerevisiae
cattgaaggtgcggcttgcaatcccttttttactttcaattctccgttaggttatttattctactacacgcagtttttttttttcaatgggttatatatctctaatatatacacatttatatgtttagacttatacagaagcaaaaaaaaatgcaaaagaagcttagtgttcataattcttcactcacgtcatgttatatatttgttaagcgtagcttcagtatatatagagattttcctttggcggggtaagggtctgtgaactttagggaaatagaataaacgtaagttaaaggtgacaagctcggatcgtcatctttcaattatcaccccaaaagatattgtaaaaaagcaagttcaatctcgtttgttacatttgtcccgtatttctactaattcaggcaaaaaaggaaagtcctacagcaaaagaggcaaaagtacagtatggaaatcgatggcaacactc

SEQ ID NO: 15617 - DNA, 428 bp, Saccharomyces cerevisiae
agaagattaacttaaatactagccattttatttagttcttatgagatataaatttgcagtagagatgtagtgttctgattatcttcacctggagcatagcgtagcccacttagcatcagctttttatgttatttcaggcattaccaaaactggttaaactattgaaactgttaccctccttttaattttgacagtttttgaataattattatggtagatcatcttaacaaaatgagctcattaggtagatgatttaattgaaaaatagtgttttgatacggttcttccttagggttaaaaccactcacattttgcttactcaccattaaaacatctttcccagttgtattttatatttctttcggtttgctgaacatcagggaaaaaaatggatataaactcaaatgcctcagtaagccccagaccag

SEQ ID NO: 15618 - DNA, 475 bp, Saccharomyces cerevisiae
ttaaatattactggctacattcattgtatatgcaaaattagttaactattgttcagaggtttacgccatgttgctaaatgtttggtgaaactaaaagactagctcaataatcaagacaataaataatgctagtaaacaggtgttcataaattacatcacttttgtgactttatgtacacatatacctacatatattatctttcaaaactatacacctcgtttagcttacgatactatggtctcctattatattggatttgtaaagcatcgacttgctgctgcaatgactgcaagttacccaaaatatcgcttgaattggatctattaacatctgcagtgaatggaaattgctgctgctgttgctgttgctgttgatgaacttgctgccctagcattccgtaattaggcttgttaggttggctatgtatatcactgttgtttaagtgaagttgccccggatgttgttgcatttgag

SEQ ID NO: 15619 - DNA, 451 bp, Saccharomyces cerevisiae
gggaaaatataaaaacagcaaaaaaacatttaatactttccatagctatatatgttttctctcctatttatattttacatatgattagcggcaaccattaccaatagtttggaaataagtatcttagtctttctaaggtttccttggacatagcctctggtttggtagagatagatttcttgatggaaccgcgcagcccatcgccagtatgcatgaactctgggatttccttggccattgagacgatgatcttagaagctaaaatatttgcattgcgcccattattcgtcaaattaccaataacggtttctacggtaacaggttctgcctcatctctccatgcgtcgtaatcggtagacatacaaatcatctggtaaggcagctcacactcacgcgccaatttggcttctggaataacactcatgttaataacatggccaccaaacattct

SEQ ID NO: 15620 - DNA, 445 bp, Saccharomyces cerevisiae
gagctgaataatacttcttcaacctgatgaactagggtggcttgcaaatgcacaaatctatataacaatatctatatatatgtatgtacaccgaattccgacatatggagaaggaataataaaatattaactaacgtctttacgcctctctttattcttttttgggtaaattgcttaaactatttggccggcccaccgcgaaaagatttggctgggcctcaactaaacgcgcctttttggacttttcacgttgcagggacagcaacgtcaaaacttctgcattaaggtagtttggtagcttggtagccactttagtatttctgccttcttcgaataccgacattatttctcgccaatccacattctctctccccatctgcatccttttatatttaatagggataggttgttttagttctttgattccgttttcatttcaagagca

SEQ ID NO: 15621 - DNA, 489 bp, Saccharomyces cerevisiae
tgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgaccgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggacc

SEQ ID NO: 15622 - DNA, 419 bp, Saccharomyces cerevisiae
ctttcctggttagtcttttggttttgtttcatagcaaaattaaatatatatatataagcttgctttcccttcaaaacacgtaaacgatagttggcaatgtacgaaaagtaccgagactttttttcaaaggcacgcgtgtccttttttgttaagacaatagatattttagcattcagaaagtttcaatttccaagacttgacgtttcaattatatggcaatctcccaacaagcacccgctcatataataccatgcaagtgaccacaagatttatatctgcgatagtctcgttttgcctgtttgcttctttcacgttggctgaaaacagcgcaagagctacgccgggatcagatttactcgttctaacagagaagaaatttaaatcattcatcgaatctcatccgttagtcctcgtcgagt

SEQ ID NO: 15623 - DNA, 406 bp, Saccharomyces cerevisiae
gttttagttaatttttttgctatatagtgcattcaaaataaaaaaaattaaagctgaaacaaaccaaatatgctattggacgttcgaaaagctaattgcgtaaaggaacactaaacacagcaagcttatgctagttcttctcaaaaatataagttcctcttgcaagaatatgaaggtaatttcactttatcgcgcaagtgcatatttctgagtttactatgtgcttcgtctgaaacctctcattatctacttaatatcggctattcatctcacgtattcacgtaatatttgatttttgtactactatttctctctgtcatacgtgcatgatacatttccttgttcaaattaaaagagtcaccgtcagcctctcaaaacaaagaaaaaagatacccggctgaacatg

SEQ ID NO: 15624 - DNA, 441 bp, Saccharomyces cerevisiae
aggtccgacagatttttgttctaagaatgtacatcgacatatagatagatataagtgtgtatataaaagaacaggtgactccgttttcaaaataatacccttactataaaatcttgacaataatttctttgatcaaggtacatatagtctttatgatagtgaagtgctttcgtggactcttcttaaagccctaaaagtctattgtcatttcttttttagtaggtacgtcatgggaagaatattatttggttgtgtatttgtatcgtgattcgctgctgtaagataggactcacttctgagaccaaactttgacatgatatccatgtttttttgtaatatttgtatctcgttatccatcatttcctcaaattttgccctccatacctgtaatttttttctaatttctagtttctggtcatagtcaacctcttcgttccaagc

SEQ ID NO: 15625 - DNA, 442 bp, Saccharomyces cerevisiae
tttgaagtcgagtacatctctttcagtgagtaacttatatatttttgaagttaacatccttattctttttttatatttttattttttttatgtttattttctattactgattttcacaaagaaaggtaaaaaaaaacatacttcagcggctatacaaccatatttaagtaaatgcactcagagaaagtatacaagtaaaaaacctaagtaaagacataaatatcccaaaataatgcaaaaactcctctttgtcttttctgtgttattgacagtagtactagcaacagcaccatttcaggtacaatgtcctagctctccacttattagggaggccaaagtaagttaaactctttgccactttaacaaatatgggccaaaactaaccgaatataccaaaacttcgtattcctttgtttattagcatgaactctgtccagaagaa

SEQ ID NO: 15626 - DNA, 500 bp, Saccharomyces cerevisiae
ggttagaatgaaaataaaattcgccagtaaatgcgtatcttggagaaaatatcaatttgttattttgtatatataaaaaattaaaaaaaaaaaaaaaaaaatactcaaatactcaaatacgtatacattatactgaaatacttcgcttgtcttcgaatctaaatcctctctctcttctgtctcaaaatgatataaataaatcacgtcaaacggtgcgtcaacatctttgttttttcacctcatgtggaattggttgaaattaacaaaggagtgggatataggatataacgcataaagtttagcatactactttcgtatattattgttcggtgaaagaaactagttccctcttatctctcaatatttgccaaaattagcttttaacaaataaaccatgagtttcctaccatcttttatcttaagcgatgaatctaaagaacgtatttccaaaattttaactttgactcataatgtagcacattatggctggatcccatttg

SEQ ID NO: 15627 - DNA, 448 bp, Saccharomyces cerevisiae
atatattatcagaaatcggcgagaaacttgatttttagatgccaacttttttatccactatattatataatttttcaatagtatttcttcaatacgaggccttttgtgaagaagagaaatcattcctggcccactgattatcatatacgatatcgagaatgatataagttataaagcttgtaaagtgtggttcgaggtgttatcgtatttactacaattggaaaagtacggattaatatacagtgaaactaatgaatcagagtgtttaaaaaaggaagacacagtaatctataatactttggtggagctacaggtttctatttacagtcacctatacttccgaagagagcttttcgtatatctgttttcctaataacatttactattgtgaattgaaatttaaagttatctcaaattcaaatgaatctgccgtttcgatttacttcga

SEQ ID NO: 15628 - DNA, 448 bp, Saccharomyces cerevisiae
gggcaagtcttaatagcgtcttttagaacttaggattttactacgtattttttagctttataatataaagcccatagaagtatgactttcatcaccttcccatctgaagaatgtacattgtacattgtatactaatttacttggttccttctacaaatacgatgctcttcgaggactgttttttccattaaacattaggatgtaaaggtgttctcaaatatataacacatttagtggtatgtatgggtgataaatttttttccatatattgtgaaaaaaaaaagaagcttgactttcgctgttcccgcttacgactacgctcccccgctaggttccctttaggccgtcattttctactgagccaaggcgattctggtagttactcgcgcttggtcccctaccaacgagtcgcctggtcgacgcttcctccgtgtaatttcgtgagcct

SEQ ID NO: 15629 - DNA, 491 bp, Saccharomyces cerevisiae
agtaattctatcttgcgttgttttctacttagcctgcgcgtatatttatatgtatgtatgtatgtatacacataattgatagaagcgatgctcaaaaaaaaagttaaagaaaagaattagatttaattaagattataagtagtgcttcataggtattaagacaacaaatggtctttcttacaaacgtaaaaatttgaagcaaaatgatgtatgtgtttaaggaatttattcgtatttttttaatgaaaaaaaaatttaaaaacagtgcatatttatttgtggcctttggtcgctacaatccaatcccatcttctttcatgtattaacacttcatcgttgcgcgttataatgcagaagataaaaaaaggatcgaagtgtttcttttccagcgaagtttcggtctcaaataataatacgtcaggaaaaagaaggaaaaaaacattgctacatcagcagatcaaagcatttactcagagtcggtggctacatcc

SEQ ID NO: 15630 - DNA, 485 bp, Saccharomyces cerevisiae
ttcgataattgatatttatatgagctacatacaatttttataaaactattgaaaatatcgacgagaaaaaggaatagtgtgacttttctgccgccttctttgacgtttgattttctatacctgatttatatctgttgctaaagaaagaattttcgcggcacacgaatgatatatatttaacgtaaggatttcttttatctggcggaagtatctcaatatattaatattaaacgctgttgaacactatcctaggaacactgacagctagaagtgatcataagacattgcatataaaataactattaattttaattaaaagaatttaattagaacaacaggaaggtgttataagaaagtgcgaatgagtacaaatacggaaatcataaaaaatagtgatttgcaaagtttaatcaatgataagaggaggttaataaatgaaataaaagactttaataaatccattaaacccttggagtttgaatcgt

SEQ ID NO: 15631 - DNA, 406 bp, Saccharomyces cerevisiae
gttcttacgaatgctttttctttttttttttttctgtttgtatattgcggtgtatacgtatagatagatagtctaaatagtaatcttcaaccttatgtatctcggctcatgcagtgaggaaatccatggataagcccggattgtagtcatcgtcgctgtcgctgtcgctgtcgctggcgtcctgtgtttccttctgtacaggttcttctgtcggttgagagtcctcttcagcgtcttcctcctcccttgcattgtcaataaacttgttcagtgtactcgtatgctcaagtgggcggggttcctggtgtagcacctcgtagccctctggtaggtcagcctctgtcatggcaacgaatatcgtgggaaactcgatcactgtggtgttcttcaacaattctccgatgca

SEQ ID NO: 15632 - DNA, 428 bp, Saccharomyces cerevisiae
ccagaaaactaagtcatcttatttatatatgtgtatatatgtgtaaattccatgtcattcaagtttactcattcctattcgaattctgaaaagagaggaaaaacagaaaactctttatagagaaaatctgatgcagcaagatagcaagtatatatacgcaaaaataccaatctaccatggttcttcaatacccccagaataaaatattggttttatcagatcacccacacaactttttaaaaacacaatttttgcaagacctgtttcattgctctagcacgggcatcagtatagttaaggaccaaacttgggaaaatagatactataaagtccattttgatctttatattgactcttgcaaagagataccagtatgggtggaagaatttataacgcctgaatgtgaaccgcttagaaatgtcatggca

SEQ ID NO: 15633 - DNA, 459 bp, Saccharomyces cerevisiae
ctgttttaaatagtgttcgcagcaatatatacaaatttcaatatatcaatgctataccaaaagaaaaaaaaaatacataaaattgatgttgatattggtctatttctttttatactatgatatgtatgcattaatctctttttagctcataaaattctttccttacaccatccttggtgacaataaggatttccagcccatcacccacttgtatatgtctttctgtagcagaagtgaacgagtctctcaccagtttgatgacttcttccacggacaagtatttcaaaggctttttgactttaccgtttgtacctggctcatattgatttttgaaattaacctgattgtccaaaaatggcatgatcaatgatgccgcagcaccacctgctctacactgttctctttcgtaggagccaactgggtcgaacgaatagacagcgcccttaccatcttcgtcaa

SEQ ID NO: 15634 - DNA, 411 bp, Saccharomyces cerevisiae
ttttcagggaattgaagaaaataaggaagaattaaattacaatttaaaaagaaattgctttagtattttatatatagacatgcagcaacttcttgatatatttcaggaagaaaaaaactgtttcaatatatacgtatcttctgctttcagctacatttttacttcagagacataaccagtcttttttcatcagtactgtccagttgtaacaacatagaaattacaggaagtaattggttccgttgttccttgtgctccaaaaatcccaacaaaacattttttatatatgcaattttttcatttttctcagagtctaactccaatgaacttgatgatcgtatcttctctaatttagttggattagagttattcgctggtgaggaatcaatattcgcgttagctagagtaccg

SEQ ID NO: 15635 - DNA, 451 bp, Saccharomyces cerevisiae
aaggcttaaagttagaaagcagtaaaagataaattcttttgttcaaaaactcctttcttattctgtattttgtgtatttttaagcttaaaatcaaataactttattttttatataattaacaaaaagaaaaataatcatatgtattgtaaacgagagtcggaatgtatcctcaactgaatatccaagcgagtccacagtagctaatagtctgaaaaaaaaaggaacccttgtccttgaacagaaatgacaaaattactacgtatttcaggatgctatataagattgtttacaagagtacaaaagtccagtatagcaacagcagattggacgtctagtttcgttgcttcatctcatagtaaccaattcttctgcgctagtcggatgaatagcaacacaattatcgaaatcagccttagtggcacccatctttatagcaacaccgaacccttg

SEQ ID NO: 15636 - DNA, 475 bp, Saccharomyces cerevisiae
attagtgaagatcgcaacaaataaaagttaatatttataaaatttgtctatactatgtacttcctatttttttgatggacgaagcagtctctctcttaattcaggatcgtatgcataaacatacagaccacgcacgccacgagttaagaggacattaatgctattcataataatcttttgcttaacgtcctctgcattgtgaatgtttttctttttggtgaaaccggccctatcgtcatacagctctggtcttagtttgatgcagtcattagccgcatcatacccaatggaacggcccaaaattacaccagcataattcagatcaaacccttggatagtatacacactacctacctcatcaatcgtgtcgcaacgctcactccaaggcgtcacttcacgtggagtatagcgatcccagcgaactttgaaattgtcaccacattcaacgtaatagtcttttccgtccaagcgatag

SEQ ID NO: 15637 - DNA, 416 bp, Saccharomyces cerevisiae
gttgtatctgtacaaaatccaaagctgagcaaataaataaataaataaatgtataagttaccgaacgggggtatttttacttttgatcaaaaatttatgtaccaactacaaagtttcctcagcacagccttcaagaagggaacacacatacaaacagtgtcaaataattgtagggataaatttaaatatggcataaactaaataagtagagcatgaaaaaactgcaaaatccaaaaagtaaaaacgaaggtcagaaagtaaagcaaaagaaaattaataaagcaatactaaatctatcatgatttcccgtaacttccattaaagctgtaaccagatttactcctactgtttgagcctctaacgcctaatggatttttagagaagctcaacctgatacctcctttgttgttgaggga

SEQ ID NO: 15638 - DNA, 410 bp, Saccharomyces cerevisiae
ttttaaattagagtattgcagtgattatatacgtttttccttataattatattttgttttatatttgttggattgtagattttaaattaaatgaaacgtagagatttgtgtaaagtataatgattgcaaggttaagagtgaaacatttttagagcactactaactagcattttccaaggtggaaagatccgaaaaagcacgattaccggaaatccaactgttgaccatttccaaacttgcctccggttgatcatagggcaccatatgaccggcatcgtatattctcaaaaaggtgaaagggccatagttcttgacttgtcccaactcttcacctgtttctttactgacccatggtcttaacatccttctctgatacctacgtttattgatccattccaactcattggacc

SEQ ID NO: 15639 - DNA, 463 bp, Saccharomyces cerevisiae
ttattcttctatagtgttctatttagctactttttatgtttaaccttttatacgatggcgggtaatctatccatgatgacgaaaaattttttttttttttgtttccgcagcacgcaagaaatctcgaaacaatgatgactcttaagcatgaaaaatatcattttgcgctttaaactagagtgatgttactcgacttcctacaacctttagccaaaagcttcaaaaaaccaaggaaatatgtccgagagtaacgcacacttctcatttccaaaggaggaagaaaaagttctatctctttgggatgaaatagatgcctttcatacttcattagaattaacaaaagacaaaccggagttttccttcttcgatgggcctccatttgccaccggtactcctcattacggtcatattcttgcttccactattaaggatattgttccaagatacgctaccatgacaggcc

SEQ ID NO: 15640 - DNA, 428 bp, Saccharomyces cerevisiae
taaatagaacttttatgtgccgccgacatggccggttttccaagcagaaatttaaatatatttaagtaaataattgtttatactattcatttattaattccttttatgatgggagtaactgctgcatgtgttttcagaagaaagatattttacgccacataaacataaattttagaatagtcaggcataataaaaaaaggtgaacagaagggaaggaacgaagtgtaagctctttagtttgtcacatatctatatacaaatatacacgttcggtcaattgcacgtacaacaatttatatacatacataacatatacgtacatatattttgaagattcaaatggatggcacaaaatcactccttagttattcttttttgtttcatcatctacctgtgtatttacaattggccccagatactccagtgaa

SEQ ID NO: 15641 - DNA, 478 bp, Saccharomyces cerevisiae
tgggagtagatggaaaaagtacgtaccctgtatacgtgtatatacaatgagatagcatctataaatggacttttcctaatcaaaaggtattggtttatgatgttttttattcatctcagtagccgcaatagcgctcggtaactttataccacagcagtctccccaagtagtatgaacatgtccttcaaaattgcactcatcatccttatcagtcccatcatgtatgtggcctcttggtggagatacaccatccggacaaggcaaaaactcgctaaagtaaaaatgttgcatgatgggcaatttactaaggacttcggctttatacatttttatcatcccttcagcaacttttgaccaagtctttacaccgctgatgtcatctagcataggagaatgccatctcaaggaggcggatgacttgaccttattaataaaagcgatacaaccaaaatataagtaccgatgagcgaacatttct

SEQ ID NO: 15642 - DNA, 487 bp, Saccharomyces cerevisiae
atgggcttttagcaatgtcattgaaggtaataatccaaacgtgcgtgtgggcatctatacatataggtttatatatattgtgtaaataaagcttgtagaaagagcctggttcgagtgtttgattttttcttcttgggcgttattatacaatatctacttcaaattatttatctaggtggtccataagcgagccgtattatcagcaccggcagaaaacagccaagcttccctcggatgccaaatagcatcaagaacacccagactattgattactttatgaccggttagtttctttagtggcacaatcatcggatttttcatcatgtcatcataaacagtggcatggaaaacatgtatggtaccgtcatcagcggcagagctgaatagaggtaactttttgtggaaattcacacttctgacggctttttcatgatatcttagtgtcttgtaaggtgtgctagccaaatccaggtcgtgccataaaact

SEQ ID NO: 15643 - DNA, 473 bp, Saccharomyces cerevisiae
gctaaacttttcttacttctccgccctatccttttctgccatctagagagcttttataagtagataacaataaaaaaaactatagtatatttaaaaaaaaaaaacaagacaaaccatcttgtcctcagttttagaatccattgttctatgctgctgcccataatgtcattatatgcgggtagcccgatgatgcggctcgagaatttccttgtttatccttttccaatagcggaacaattgataataaagcaatgtaagcagaagcgaaaaataaaaagaaataggctgcagagattcacaggctgcgctctagaaacatttgaaatcaaggcaaacatagaacacttgataaaattcttaccataataccaccattgatgattcaaaaaatgagcccaagcttaaggaggccatcaacgaggtctagttctggttcaagtaatatcccacaatcgccctctgtacgatcaact

SEQ ID NO: 15644 - DNA, 423 bp, Saccharomyces cerevisiae
aggatggaataaagttttgttgtgatattaaataggagattgaaataaagtgttagatgctttctatatactcattctaatgcctgctaataactcttcgataattcgttgatttctatcattactttgaatggtactcaatatgccaaaacactgcagtaatgtcaatttatctgtttctgtgacattactttcttcttcttgattgaaaatgtaaagttgaaaacttttgctgataccatcgttactatttacgaagttttcataacaaggtaagactattgaatctctaaagcacataagcaaaagaaacccaatagaataattaccattaatgtgagtccgactttcattgcctgactttaaaaccgtagaattaccatcttctctgatactctgatccaacggtaataacacagcggc

SEQ ID NO: 15645 - DNA, 441 bp, Saccharomyces cerevisiae
ctggccaaataagattagtatagttagtacgtacatacttgttattttacacagttgcgctttttatcacggttgcgcttactattttcttctttcctttgggcggctactcgccctttgtctatttctcgccatcgccacatactctctaccgcgatcaatcttttcctgggtaataccattcaacgcaaccttcttcttcatcaggactttctcaaagatatcattcggattgagcaatctttttgggaaattttgaatcacttgcaaaatctccatatctgcctcttcctgcgtcttaatcttgttctttaatcttttgaaagttgaatcagagtcattactaccaccgaaggtgtacgaagagtactgtctaaacagtttctggcttttactctccaaaaactcgctttcgctcaatttcagtatccccaaagccac

SEQ ID NO: 15646 - DNA, 459 bp, Saccharomyces cerevisiae
gttgaagcttgattttattttaattatatgtataaaaatcataaaacaactatataattaattataactcaaaaacttttccagtaaatgtctgttttttgggcaggaacaatggccaatagctcacgtactgttcgtgggggccttaagcctggtatctaggctctgatttccagaagaaagtgacatcgatgaatgcactcaagagattttatgtgttgtgaatatgtatatatttatttagaaaaaaaaaaaaaaaaaaaaaccaaaatcatataccttaggcatcccgtttccctcttcatcatttttgtccctttatatcaatttttttagacttcatataattttgtatcaactgtaccctacatcccttggtattcaaaatcttgatattactacttttgccattactgtcagtgatttgtttgtttaatatgaactccgtcaagttttgct

SEQ ID NO: 15647 - DNA, 464 bp, Saccharomyces cerevisiae
tgagcacgctatttgtagtttgtaaaccgaatataaatactctattctactacttgtagattcacttggtggaaagaagttacatcaacattctgtcaccttgttgatgcacagaaaaaaagacactttattattgttgaataacattgtctgtggtatatatatatatactatgatattacagtttttaagacattaatgtattaacagcccattttacgcttaatgtcctcaaatcggtataggtttgtcccacgccaacgaataagataggaatccccgtagcataaaccatatttaccatagtacccagcatttcaccaactgtgtcacacttggagataataaagaagtcaagatttcttccctttccgaaggcatcattaaaatttttggcttgctggacagaatcagtacctactaaagcctctccaaccataatgattttatctggcttggcttgg

SEQ ID NO: 15648 - DNA, 455 bp, Saccharomyces cerevisiae
cattctaatgacataactatttgacgacgtgaattagaaacacatacttttacgtgtggctgcctctaagaattaaacttcttttctttttattcttattttctttaatgaatatatacgctatacttgtactaagtcgtgtctttattcctcgcccgccttcgtactttattccagttccatatctgcgtcaaaatcatcgtcggcattattacttccagttttgctgtcatgacctccctttcttagagctttgttattctgatcaaagatctccttttgtgttctcaaccttttagccatgttgacagggtcataagtcaatgaagatctttttttattgagcgaagccttgtccttacttgcctgactcattaaattcgacttgtcaataagtgggtggctggcatccaatgataacgtcacgtttagctctagggcatttttcaaaagcg

SEQ ID NO: 15649 - DNA, 400 bp, Saccharomyces cerevisiae
tctatttctatgtactttgccattcattatatacatcaagagagtctgacatagtattttcgttggcatagcaaccgattgataatgaaacatcactcaagacgaattgacaaatgggccactatggtaaaacaattctttacatgataccaccagtatatagaaaggttctcgtgttgatgaattatataagaaagtgaaaatcgatttcaagataattactctttttacctcctctttcattgtggtcaccgtttttgaacacaacatgcaccaagattttcaagaagacgagcatgagtatccagacatcagacgcaatccgctgcatgaggtgaccatgacttcctacatactggggattcttttaggtatatttgttggtctttttccacaaatt

SEQ ID NO: 15650 - DNA, 490 bp, Saccharomyces cerevisiae
gttttgcatatgtattatgcaggttcatttgttccttcccttatttcttttcatagtatttatttttatttatttatttatttttttttggattttattttatttcttttttaatgctaagaaagtaattccgcataattaaacgtgtgctggcctcgataggtacctatagtatacagaagcttacgaaaagctcctgcaggatggcacttctaaaattcgcgctcaacatggccgtattgtacattatatcgttctatcattatatcgtatacgcccgcattacccgacaactccgtctgcaacgcgttgaccagaaaactcgaacaagagatcgcataaaaaaccaaaaggaaacgaattacttgtcaaatagttattgtaatggatcctctagaaaggcaaacagtagatttatttccttcttttctagaaacatcattataactaacaatatataattggaataatggctggttgggatattttt

SEQ ID NO: 15651 - DNA, 436 bp, Saccharomyces cerevisiae
agctgattcatttatatttcatcttttcttttttttttttttacaattcagtagttttatataacttcccataaatgtattatttttttaatacgactataatatacctctatacccttatttatctctttacctttgcttttaagctaaacaaatcttcattaacaggtattatattactggcgtcgcgtttcgtttaggcgcatcgagccgagacttcagaatcacaaatgctttgtatatatgttacgtattcagtattgcccaacatgcaactagattcaactaagcagacgtgggtacttacatgagaagcagatcattgaaattttactaagttaaagaagaggaagggctccaatgattgtaagaatgatacgtctttgtaaaggtccaaagttgttgcgaagtcaattcgcatcagcaagtgcactat

SEQ ID NO: 15652 - DNA, 433 bp, Saccharomyces cerevisiae
ccagtgacttagctgggagttttttttatctctttggcacccttctccccatttctagtaagcgcttttttctctttacttcttctcttatataaaacgcctttaaaataatcgttatcggttttttggcactcttttaaatggtatatatgatgttacaggaaaacttagttgttttcatattgaaaatccgcgcaggataacgcttgtgtaaaaccgagtgtcctgaaggtgggtaaggcggtccttattatcacttactcgaacgttgacattggtacagtccctatcaggtaggatgtactgacgttttgacaatagtttcgattttatggattgtttgaaaagagcgagacagtgacaaaacgtgatagattacatagtagtcagtatacaactttccgtaattagccacgaggccagaaaggaagag

SEQ ID NO: 15653 - DNA, 414 bp, Saccharomyces cerevisiae
ggcaagtcaattaaacgtcaaaaattaaggttggacctttcaaatagttctattcctttgttgacgcattgataatgttaatttattgaatggtaacgttatgccattgatagggagcatataagtttatatgtattaggacagttctaattgtttattattaatctaacggtagtttcaagcagtatcttacatcactgcagcttctgagtgtctaaatgataaactgcataaaaaatagccgcgcaagctcgccatcactgtaaatgaaatttagacgcaaaacataaccgcggatgtaaacttacttaataagagcgattggcaaaagagccacaaaaaaaaattggatcaatatctggtgcatgggtctaaaaaaattaagcaaaaccacaacaccacgcgttatgacag

SEQ ID NO: 15654 - DNA, 473 bp, Saccharomyces cerevisiae
tatgcaacaatatgtaggctcatttgagagtatagaccatatatacatatttatgggaaaaataaacttaccttccaatagaagttatagatgccatcatcatgcctattgttatggtccgtatctctttacagaagttcacagccaaatgcgttgatatggtatattttttctcttcagttttttatcaaaaaatgccacaaccttgatttaatcttgcatactaacatccacatcttgagctttttgcttttcgtcattgctttcttcctcatcactttcactactattattcagcactccaatcatcttattgtaaatttctttatctttcgcactcaattcatttaagggcaaattacctgagttcttctcttgcagccaaaagaagtacctttcgttggatgaaaaaactaaagcaaatattctgccacttttactggattttattggaacccacatggtctctccag

SEQ ID NO: 15655 - DNA, 414 bp, Saccharomyces cerevisiae
tttgcggtcaacgaagttgaaaacggaaaagtggtgataagaatgaaaataaaagacatataattgaatagtctctgtcacccttgctatcgtatcaacagttgctcttctatcttgttttgcgtatgtattttttctaagaagaatatgtaggttttagtcattttttgttgattaagggaatgaaaattgtcctaaagaaccctttcagtggttcagctttgagaagtttcaatattgatttccgtcgcatgcctcatcgttaatttttctctagtttttatttatttcagaaattcaagttttttactttcaagaaattaaataatgtaattttacaaataaacataaacaagtagaagtaaatgaagaagcataaaaatagttttctatatggtatgagtccgaaaagcc

SEQ ID NO: 15656 - DNA, 453 bp, Saccharomyces cerevisiae
tttaagagtttgctattcggttaatctcccgtttttttttttttttttttttttattttcctttttttttttttaatgtttttagcatattatgtagagtgttaaggccttaaaagttatttgcatcattgttaaaaatgacatgtattgtataagagttcggctcttcgatgccgtcagaaacatttttggaaggtgcactccgtattcgagacacttctgaaacggacaagtcaccaaactactctgaaaacaacaaaaaaaagccttttcttataatttgaaagcttctcccgcagcattatcgatatcgtgaaacttccaaaatctttcttaattaaaccggacatcagtgtctacaacattagagcaagtcactcagttcatgtaatacatctggacaattatgtctaataaagagataacttgtatcaaaccgtttaaaattattgc

SEQ ID NO: 15657 - DNA, 488 bp, Saccharomyces cerevisiae
atagatttcactttttttttggctagtaatattacatacatctttatctagataattaatttattcgtttgttagctcgcttataatgtcatccattacctcaaagatttgcaccttagtattatttctgtacttattgttaaatttactgctcgcttcaatgtctgtgactatattgccacccgctttttgtaaaatagtaatgtcttttatcattggcctttttaaatcgcttaaagatatggcaattatatattgcatatcctttatttcaaattgtacttttccaagctgggtaaagatttcaaaatttaatatagtcgtctttgaccctttgagtaaaaagtgcttttcccaaaattttgttagcaaattaattgactgacataattctgattcattggccattaaatgtccagaatcctctttttttgattgctctccttttcgtattatttgatttttaacttcatgcatttccttgagct

SEQ ID NO: 15658 - DNA, 488 bp, Saccharomyces cerevisiae
tttttagtcaggctgaaacactgaaattaaaagagggaagataaatatcattactattatctgactaaaatatgtgtcgagtatttacttacctaaatagccaagaagtaaaaaaaatgcgtatcaaaaatgaataaaacgtaaaattatcggggaaaaaccttgtattttcaaagagtaataaaacgggtgaattaaaatcacaatatatgtatggctgaagttcaacataagtcataactagagaaacttcttcttgcccatgagttaatattccacctcataattccgtaatctgtaccaataatcaaggagctcccattcctatcttcaacccaatcgatacctgatatattgttttcttctgagaattcgttactttcctgagttgtaatcactggtcttctcaaaaaattggatgtgcctctattattcctactatttgcagcaaaattgtcatcatctgacggtaagtctggcgttgaagg

SEQ ID NO: 15659 - DNA, 474 bp, Saccharomyces cerevisiae
tagccagtaggtagatacggcgttatttaattttattttatataactagtacttaacacatcgagtttatttttactcgacattatgacttttttttggttttgttgcggctttgaagttttttcaactagaggttattattttgttctgaaaaaacgttaatgatttaaatgaatcattgtgatgagggtcctagatttaaatatcttgcaaaaagaagtactaatatacaattttttcattcccgttaatgaaaatgcttgaatttttatattgtatattgatacactctattcatgttccggcaacaattattttttttttaattctgtaaatttactttttgacgtattctttcagcatttctgtgcttatgttagaattcaagagagtattccctattcctggtaacgtaaattcgctttgtaaatcaacgatacatgattctcatatcccaacaaaaatgccacaaaa

SEQ ID NO: 15660 - DNA, 412 bp, Saccharomyces cerevisiae
tgggcaagttgaaataaatagcaattaataactgatattactatttatgttatataatcatcgttttctacggatatgcagttctatttttagtaaaagaaacgttaaaatttttctttcagtttttcgccctgaaaaagagaaaaatgtcacgaagaaaacaagaggatatttgtttattttgattttaactgcctccttataaagaaacttttcctcattcacaatttggacttcttcttgtttttttcaatataagtttattgagatagacaactaaccaaaaagaaaaacggtcaaagatgcgtttctctactacactcgctactgcagctactgcgctatttttcacagcctcccaagtttcagctattggtgaactagcctttaacttgggtgtcaagaacaacga

SEQ ID NO: 15661 - DNA, 445 bp, Saccharomyces cerevisiae
tcttcctgaacgtaatgtttaaggttaattaattatttgatgtataagtaacctttcgtttaaaaatttcatatgggcgataatatatcaatatttattaattacaatttactctatttgctcgtatagagtatatactcgctaaatacattttgattaccaatcatcttcctcttcatcttcgttagcctcctcgtcatcactctctaatctcattttattggccctagcagcaagcgcattcgccaaaccatcacccaaacttgcttgggctgcagctggaataacgtttgcagaggtgttatcatgttgtacagaattcagaacgggtttaggaacatccctgttttgaggaggagtagggatattattatttccggaatgtggtttcatgtaagctgttggcacccaaccttccttagagccatccagaagtttcccgaga

SEQ ID NO: 15662 - DNA, 483 bp, Saccharomyces cerevisiae
ataaatatacggccttgttagcgttagatacatatgaaataaaattttattgctttttcaagtgcactaaagtataaggcaaaatttttttaatctataatatactttctcgatgtgtctctatataaccttgtgtctttcttattactggcacggctttgaattttcagagtgcagttctgattaaacacgcgaggatttttgttcgtggatatttgcaacgatgagcaatgtgaagtgagcaagatagagaaacgccatagaaaagagcatagtgagaaaatcttcaacatcagggctatgtcaggccagttagttcaatggaaaagctctccagatcgagtcacccaaagcgctataaaggaagcactgcattctcccttggctgatggcgacatgaacgaaatgaatgttcccgttgatccgttggaaaacaaggtaaatagcacaaacataatcgaaggaagtcccaaagcaaatcca

SEQ ID NO: 15663 - DNA, 418 bp, Saccharomyces cerevisiae
aagaagtaaaacataatgtagggaacactccaataagaaataaaccattgttgaagtagtaatataaactatcgttcgttattttataaaatatgtattgttacatatatatacatatatagggaatgcatgtgcacaattggtttgagtggaaggaataatccaaaatcatagcagtttggtctttatgatctcttgtctgattctgaatgtgtaatatgccataaccaacataatgaaaattaatggaagtaaccaaatcattagttttctggcaatttcgtcgacctgaggaccatcttgtccatgacgtttggtagcttccctatacttttcttgttcaaccaggactttctccaatttctgattgattgataagaagtctttgaaattttctttatcctcagcgattgcatca

SEQ ID NO: 15664 - DNA, 465 bp, Saccharomyces cerevisiae
ggtcctaaataaacgagctaaatacctaataatatacaagttttttatgtcttattatatgaaggaaaataaggaagtggagagaatttgtgattcagcaatggtccctccgctaaggtcccgcctctggccagttatgtcagaagaggagcataggcatacattccatttttgatggcttaatggggcccataaatttacatcactacattattattcctatacaagttataataaaatagttcataaatgaatattttgcgtcattttttaatttcttgtcgtcgggtaagggacctagtattacccgcatcacggaaaggggaattttcagaaatgataacgaataagagagtacaccagaagagcaaatctctttaagaagtttagcagcaaatatcggtttaaaaacaaacaaaagcaaaggaaaagaactactaaatcttcgaggactttcccaatttt

SEQ ID NO: 15665 - DNA, 498 bp, Saccharomyces cerevisiae
tagaagtaagatttccgagaaataaagtttctctctatatatctttgatctcttatttaattattcaactcgcaaaaataaaaagaatattttgttatttcaaaagtaaaaaagtatgtattagaatagaggacatatataaaaatcatatatatcgatgcttgaatgtataaggaaaagcgtcaaattatgaacggtaggtacttaggatgctgatgtcacataaagtcagagggtataactttaaaaagtaattttttagaatcttttagcgtcaaaacgttacacgtacatttgaacagtgttaagagtagattaattcaaattatacttttacgtgctccgatacagtctctacctcttcgttgtcagtgcaaataacaattggcttatcatgaactgttcttggagatggagaatatcctttcagactcgtaatattgatgacggtagttattctgcgacattgagtagtactagcatcccttataaccggaa

SEQ ID NO: 15666 - DNA, 430 bp, Saccharomyces cerevisiae
caaagactttagatcagtaaacagacatataaaaacataggtatatttatatataaatagataacattatgctttactatccacgttcgaatattatttactttgtgaagaaactcatccatgtcatggggctactcaatcttctacaatctttcctgtaatccacatttcctttgcgtcaaggaaaattgaccttaacttctgatagtccaagcaagttgatttgaaatttaggatcactttttgagcatctaatgaagagcttgaagcagaatgaattttcccgattatgtttcccggattcactctggatatataaatgttgttaggagctaaaaataggcagccattttccctcaattccgcgacgtaagcacccgtatgatgaatatattgaacatatttgaactgtggtttgccccatgaatac

SEQ ID NO: 15667 - DNA, 458 bp, Saccharomyces cerevisiae
ttaaagtgtatggtttccttgtttctaatataaatatattaattaagtctttatacattctctcttactcaacgccgaaggaatacccttctacactttattcattttaaatcatgtactgttatatacacgctagtaggattgatcttatttaatcatatttcgcacgttacccgactgctttcagttttgccgctttgtgataatgaggaatttcagctagcttttaatgagccgatactaaatcaccatgattttgggagaggaaaagaagaaaaggtaaaacaacgaatatttttcaaataccttagttactgaatatccataactactcgtataattggtgagaaaatagtgcatatttagtttactttttgcctttgattgaaaatatatattcatggtgctttttactcggtgtgaaaaggcaagaaaggagaaactcgccgctggttata

SEQ ID NO: 15668 - DNA, 469 bp, Saccharomyces cerevisiae
tagccatgggcggctacttcttggaaatatatactttccttttacatatttagtatagttatacatgtggatgtgtatggaggtaagatcagatagacccttcactgttttctgtgtattccttgtgacatagtggatttgtgcagctactgcttataggaagcagtgcctgcaaaacaattcattcgttggttgatgtggcgcgctgactgaatgtgtagggtctgttgttacccccttgctccgggggcccacatctctctgacgcgaagaaaggctcgagatgtgccagtcgtaaacaccgcctcatttcccttgcattctcctccagtgaaaaagcagtacgacctatctccgaaaaaaaaaaacctcctgtgcgtttactgtggatcatgcaacacgatttctgtagattaaagacgtttttggcatggactaagctaaattccgtttgattagccgcccataa

SEQ ID NO: 15669 - DNA, 492 bp, Saccharomyces cerevisiae
tgacgtccgctttctcagtgaaacaaaacgcacacacaatatacttatgtacagacaatatgtatgctaattaatctatatcatgttgatcttgagggaaggtagtatcaatgtcttcctttggtgctaaaatttcaggttcctcaggttcctgtaaacctgggcgttccttcttagatgcgcttacaccgatcataatcgaacaaacaaggactaatattaccaaaagaccgcttctggttgtctgccatcttaaattttcgatatgtgacctgatatcccccagtatcttggtttgaatcttgttagaacagtcgttcaatttcaggtttaattgtcgatacaaaagggtgttttctaatttttgattgttaaattctaatttagcgtccttttgcaaaagatctattatgatttcattcagttcatcatggattgagttaagttctctcttgagttttaataattgcaagtggtgctcatttagttgcg

SEQ ID NO: 15670 - DNA, 487 bp, Saccharomyces cerevisiae
atctcataagaatggtggtgattatatatcttatgttattaagaattctcaaattattctatatgaaaacaccgtaacttgcttctctccttggttttacataatgacataatgcgatcgaaaactagaggtacaggtattgctggattggcgagagtttttaccttcttttctggcgtacagctatcaccttctcgtttggtaaaatgaaagaacattttgttgtcttagccaaatatttaatctatgaagaaaacggagtttaccggtaattctaaataaaagtttggttagggattgtgcctcatagagaagcaattggtactcatcttattaaagtattactataaacattagaaagagtccctgagcgttgctaatgggaagctattcgcgcttttagtaaattattaaaatacgccaaaaataaatgtaatccggatatacctcttcttttaaccttcccaaacgtgtcccacaccaaatt

SEQ ID NO: 15671 - DNA, 448 bp, Saccharomyces cerevisiae
atagtttggcagactcctaatggcatcaattcgacctcgatgtccgtctgcacgagtaccctttatataaacaattgagatgagaatattagaaaaatgggttttagttatgtaggtatatgtgcatacatacgtattatcgaagtttttgctacctgtttattaactgagtatgtatattaagataaattaattaaagaaaatttaagcgtcttccttcaataaagcatctctcttttcagcaactctttgagctcttctgtcacgagcagctctgttcttcaatcttctagcttcagcttcttcgttcaaagccttttcacgttgagcatcagccttagcttggatgatgtgttcaaccaaggctctcttgtgtttgaaagcgttacccttagattccttgtacaaaacatggtacaagtgcttgtcaatcttaccagcatcacgg

SEQ ID NO: 15672 - DNA, 437 bp, Saccharomyces cerevisiae
ataccgcataaatccattaactaggctttcatgaatggtggctcgaaaatattcgttaatatcaatatgtctgttatataatgttttatgtacaagagataatgtagatctgtaatattcaatcaaataggcatttgtttgaaatccatacgtctctaagatataatccaagccatgattttgaaatcaggatcgcaaacctgatcatttaatttttacctttttttaaaatataaattaacatttattaataaataggtgtatttgagaagtttcattttcgttcaacagcccagttatcatcatttcacaaacaagaaggagatattagcattttctcccggatccgattaacacagtttttttgtttaatccggtgtgaagaagatttataaatgtcgtgatattttttaatgtggagattgtacgatgacggg

SEQ ID NO: 15673 - DNA, 436 bp, Saccharomyces cerevisiae
accgttttgttgcgttcgtacggcactagcagccgcgtaattcgttcacacacttcaatacatatgtatgtatacgtatatagtctgttgcgacacataataattgacaggtttgactagcgagtatgtattatcaggaaatataaaagaaaactaagctttacctaacttcaaaagaagaagacctgcctattccacctctttcaaaagttcttcgatggtttcggacaacgaagaaggtttggttagtgaagagtatctttcgtacactttaccctttttatcgactaagaatttttcaaaattccatttgatacctctcaagcccaacataccggatttttggctcttcaaaaacttgtaaacagggtcctcattgccaccattaacgtcaatttttttcataatggggaaagtcacgccatagttcagttgg

SEQ ID NO: 15674 - DNA, 456 bp, Saccharomyces cerevisiae
tttgactaaatagtgcgaatattccttatttacaggctaagtggtgtcactatccccattatttaatatatacagatataaagaacagcaaactttgtcatgtacttctctgaatgtttacgcgaggattacggtatgtatgattgaacatcgctgcagcatggattttagtaagagccgttgtcatggcaaccaattaaagctctttaattaccgtcaagcatacttaggatacagatacaataaaaccccttattaagttcgagcaggcacatcttgacagaataaaccttttaaatcgtcatatggagcatggtctggtatcaagttttactactttttcgctttgttgtcagaggatagaaatttactttttctagttgtgcgtataaagaacactatggatgcagtaatacagaaagtaatctgttctacttcggtgcattttcaaactga

SEQ ID NO: 15675 - DNA, 496 bp, Saccharomyces cerevisiae
aatactcattcatgggaatatcaagtatatgtatgtataaactgtcccttataaatagtgtcctttcgattacatactatgctaatgacgtgtaaaaagattcatgcaccagtgtatgagtacacaaatataaccactgcatgttatcacttcttcctttatggaaagatcgatgtgtcttaaaaagcttcaaaaacacttagaattttaaaattacaatgttatatcgttgacattaattaaaggtacacatcagaagaaagaccctgtcgtactaaagatttttgttctaaatctagttaaaactacttattgaatcttagcccccttgtctgaagattcagtattcccagtcgtttctatattatcatcttgtggtacagtagtaatggatgcaggcagtacacttgcagtagagctgtccaaattatccgactgctcctgtttcgtaattttacctttttcggtttcactctctattccctggtttccagca

SEQ ID NO: 15676 - DNA, 461 bp, Saccharomyces cerevisiae
ataaggtaagttcaaacgatttgttggaagacaattggtttgatgtgtatttttctataatatataaatcttagactattcattaaccttattttatttaccttctacccgaaaatgggtttcttttgctgaaatagttctttcatgtaaatattgtttaagcagaaggcattctttgccctcttgctcgtgtgggttcctttccgctaataatcaatcattctcatactgttcaatatcataattatctctgcgacgatttttcatccgcctcctccgaaactggaaaaagcgatgagataaaattttcaggaatccatcagcaattttatatgatagatagaagtctattacgttgagcttccaattttaaaggaatactgtccatattcattgaaagcaaaataaaacataaccaggaaatatggtgaatgaaacaggagaaagtcaaaaagcggcaa

SEQ ID NO: 15677 - DNA, 408 bp, Saccharomyces cerevisiae
tagaccccaaaagaacaaattctgagtgattacttctctttatatttgttaacaaatgcctctggatctacactgatataacatataatagtctataacctctttctctttttctcttcgctttacgcttttttctctaactgttagaacgacaaagtatctcagaagggaatttcgtaagcaagatattttacgactaatcatttttttgttgtataaaaacgtatgtgagattgattcactaattcttcggagtcctggaaggcttaccttatctatgcattcgtacagttgtgtgcaatgttaaaaatggtgactgtatctacgtatctataaaaaaaggttaactaccggaaaatcatttcttctcgtaaagtgtatatttaggttcggaaatcataaacattg

SEQ ID NO: 15678 - DNA, 446 bp, Saccharomyces cerevisiae
aacatttgtggctgttcaaataagcataggtaaaacagaatacataaaaataagggaaaaaaagaaagatcatttgtaatgtacttactacatacatatagaattctcctctcttagattatcatataatatacaaagtttatgggtcttatttcttctgtcttttagcagagggctcaatatcagtggcactgacgaactcttcttcgtattcttgtccatcatccgaatacgacgcttcatcttcgtagtcttcatctacctctccatcaccttcttcagttccttggtcgaatttggatttcaaacccttcatctttcttgtttgtagtttacccaaatcttgtttgcccatatggattctacccaatttatcacccatgatatctaattctacattcttctttgtcttcatttctaattgttttggcttcttgtgagcttca

SEQ ID NO: 15679 - DNA, 429 bp, Saccharomyces cerevisiae
gatatttgaccaagagttgttctagtcttataagcaataggtaaacctacacgcttttgttgtataatgtagtataatttttgatatctgaaaaattatcgcactgaagtataacgtaatgttttgtaacgaagttactctttaagtaaatcactcttggcatgcattggataacatagccatgatgcaacgccagcaaaaatccaaattgattgcaatagggaactatgaaaaatctggtactcccggccacgctaaaatgattttccactaaggtgttcctaaaacctttcggatcctttatgtctctggcatcataaatgtctgtttaaattaaagtatattgaattggtgttgaaattcagcataatcgaaccactctcatgtgggatgtagcatcattcttaacgcttttactatgcgatcgcc

SEQ ID NO: 15680 - DNA, 480 bp, Saccharomyces cerevisiae
acacaaattttgacaatcacaaagaagaaaaaagaaactatttacatatttaaacatctacctcatgattatttatgtacgaaaatttataatttagtataatttagtattttttgcttcttatacttagctttaacttagctgaacgattagaccttagcaaacacaaaatataaaaatatgaaacataaaaaatacacatgttgaagaaaagtaaaaatcttcacgtagcgatgcattgcccaccttttaaatctatattgaagatctcctctagaagtccaatgtttaatacgtaactttcttgatatatattacatattttggataactccaccgagatttatctaattttgttgctatttcttactggaagtgcaaaaaagcagcgcactatcaattataatatacagattttgaagatactagtgctttcttcttccttttggttgaaccaattcaaaaccgtcttcgtcaaca

SEQ ID NO: 15681 - DNA, 444 bp, Saccharomyces cerevisiae
atggctcaacagagtgagtgtcatttttagctaactacatacttgatttatctatatatacatatatactactcgttttattatgatgtcgtaacaaatgacttattcgagaaaagaaaacgtgaaaaaataagctaaaaatttggcgatgaggttctctgttgaagttggaacccgcaattcatgattttggtaaggtcaaggatcatcagtaattagcttaaagtaagaactactcaataatattaaaccatttatccttggctcgtctttctattgaccaatcaatactattttaaacatctcttctaccacatactttcaatcagactagaatgaaattggatacttctcatatgagatatttgacaactgatgattttcgtgtcctccaggccgttgaacaaggttctagaagtcacgaagtcgttccaactcccttga

SEQ ID NO: 15682 - DNA, 484 bp, Saccharomyces cerevisiae
caatgtgtgtgattgttaagtctggctgatgactcctcatgataactcatgtgtgtgtaaaattgagtttttcatggttgttttcaaagataaattacatagtagtgtaatcaaaatagtgtatgatttttttttatttttagaaaatctaaataataaataaataaaaaataaaatacaatccttacagagattaggccgtggagtgtggagtatgagtatgcacaacttatagttatgatctactttttctcgtcctgattttttatcttttttatattataggaaaaaaagaaaacgtaccacaatttaagtagagttcgacttatcgcttactaagagagaaagaaagagaacaagcgaatacaaacagctaatgtttcatgctttcaccttccttaaaggtggtagattttactcttcactaacagttaaatcattgtacgagcaggtacaccatactagccatgatcccatttcaatt

SEQ ID NO: 15683 - DNA, 428 bp, Saccharomyces cerevisiae
tccaggtactgctgctatttgattgtagattttcttttttcttttcttttttttttttgacgactctgtaatactctatttattatttagtttagttttctatttaatatgatggaattcataaaaaaaaaaaatacacatagccatgccaggtaattgcagatcaactgataaattagaaaaaaattaatgcatctttaaggttttaaattaaaaatgttttaactttaaagtcactgagcaataaaagttctacctaatgttgtaaaactgtattcataaccgaaacacattatgattatgtcatttggtattccacaccaaagcgaggagcattcaaaatgataccatttatgataccggcaatcaaaccagcaattggtaaagttaaaaaccaaccagaataacaccaggctaccattctccaa

SEQ ID NO: 15684 - DNA, 403 bp, Saccharomyces cerevisiae
agaatacacaagatgtatagagtatacgtcgttatacagtaggtaaaaaatgttcgttatatattatatcctctagtatatcaatgcagtagcagcagtcattcatcgtacacgtaaaaatctactgtttcgtctgcggtaacaaacatcgaatatttagggttgaatgcaattgacctggggcaggtctcatgagaaacacagggaatgaacccttgcggccttaatactttgttacttattgaatcagaatgattccaaatggcaatcctaccgtcataatcggttccaaggacgaattcaccatctggtgtgaaacaagcagatccagaatctagaaattctctcatcgggaaggcccttgttcctattagttcgaataattgttgacctgtgaatgcgt

SEQ ID NO: 15685 - DNA, 414 bp, Saccharomyces cerevisiae
cacacaaaactgccttcgatgggcaatgcgaatatatagcggaaccactaaagtaatagtggatgacgtgaatagcaacaaatatctatcatagtagctttatatatttatatatattacaatactattatgcaccctattacccgcaatagttgatagtgacctaccaattttagatacggtcgctgacaaatagtaaggccatcgcccagggatatatgatgactatctaagtaactcactcagagtaaagaccgacagagttcattagtgtgttatattttctatttcagatacatcattttcattaaaatatatcgcatacacgaaggaactgctacaactggaagatgttgaaatcaactgctacaagatcgataacaagattatctcaagtttacaacgttccagcgg

SEQ ID NO: 15686 - DNA, 426 bp, Saccharomyces cerevisiae
aaaatataactgatgtaggcagaaaaaaaaataatatatgaatctgtctaatagatacttatgtgtacgtatataggtatttttttctatcctctattcatggtatttccgcttcccttagcatgactttccttgaactcgtcccactcacgagctttataggtttctctatcttgccagtccatgttttcttcatctggtgcttgctctggttcttcgccaccttgaagaacgcgaccttcttcaaactctttatctaaaaattcctccaccgacattgttggtccatattgaccatatcctcgcactttttgttgcagttgttgccttttgtcgacaagcgtgaagttcctcaagacttgaccttttttgtctatcaatggcttatttatattctctaatttatcggtaaaaccagtggaatca

SEQ ID NO: 15687 - DNA, 411 bp, Saccharomyces cerevisiae
tctattacacctttatccttactacgctatttcattccaacatacatttattttttttttttttttaatatatatttagttactttttccctctaatttttgataataacaacttatatacaaacatacaaactattttttcgttttcaaatacttattttttcgaacacaaagtgaaaacaactttttctcatatattactgttctcatactagaatttctataaaccgttacgtaattttttcgctatgtatagttcactcctcacgctaaatgtttaatttatcaaatttcatctctaccgaatcagtatccctagatgacggcgaaccctcaacactagccctacgaattccctcattcttattactgttactgtcatcactacgtttcggaatcgcaccagaatat

SEQ ID NO: 15688 - DNA, 444 bp, Saccharomyces cerevisiae
ttagttactgaagagtacgtgagcgctcacatatatacaaatatttataccgattaatatttacgttcctccctctctctaattattcattgatttattcaagaattagcgttataacaataaatggttggcgcaggcaattaatttttctttactcttccaaaccctctgttaacgacaatcaaataacctgatctgccaaggctccatcatatctggcctagaacagtttttttttttcgattatttgttcgttcttgtggtggttactcattggcagaatcccgaaaatcatgattagtagatgaatgactcactttttggataagctggcgcaaattgaaacatgtgaaaaaaaaaaaaaaggattataaaaggtcagcgaagcacagaactctgagataagactacctttctttagctaggggagaatattcgcaattg

SEQ ID NO: 15689 - DNA, 488 bp, Saccharomyces cerevisiae
gtctgaagaatgaatgatttgatgatttctttttccctccatttttcttactgaatatatcaatgatatagacttgtatagtttattatttcaaattaagtagctatatatagtcaagataacgtttgtttgacacgattacattattcgtcgacatcttttttcagcctgtcgtggtagcaatttgaggagtattattaattgaataggttcattttgcgctcgcataaacagttttcgtcagggacagtatgttggaatgagtggtaattaatggtgacatgacatgttatagcaataaccttgatgtttacatcgtagtttaatgtacaccccgcgaattcgttcaagtaggagtgcaccaattgcaaagggaaaagctgaatgggcagttcgaatagtacttaagattagttaaaagtccatgattgaacattgatgtggtagttacatgcatgatgaatatgcgccatgagaggttggtgaat

SEQ ID NO: 15690 - DNA, 494 bp, Saccharomyces cerevisiae
ggtaaatgatttcacaaatgacaacaatcttcaagaaaaatgaaaatgtatatctatatataaaatcgtcatatatatacagaatacatgtatagaattattataattataattttctcttcgcaactctatctaaaacacaatacttagatttaaggtcccgtacaccccggctagtgggcattgtttttgcacccatatttgtaattctaaattcagaacggaaatactggccatgtagatcaagaaaagatacaaggtcatcgaaccaggcagcaatgatttttctataatcttctaaagtgaagcatgacgaccatagctcgttgaatatgcatagaacgcttctgtttttaacgtggctgatatctttaacaaaggcttttaatataaaattaccacacactgaaaaaaaagaccatttggaatccaacgctgtgctggcatgcgcatcctatataaatactctgaagtggtcatttgatagctccgtc

SEQ ID NO: 15691 - DNA, 455 bp, Saccharomyces cerevisiae
ggaatttgattatacgtcagaattttaatgaatatataagtctgtacactatgctatgcacatatactcaaacaaattcaatactaagtaccgaaaaggaaagtggtatatatatatttatatatataagtaggtacctctactcttaatgatcacattttttcttcaaccagtttgtacagtgcttcaatgtctgcggagaattttctgataccatctgatagtttttctgtagccatttgatcttcgtttaaaacatatctgaaatgaggctcgtcgttgataaaagagactttttcgacgccttcttccttagcactctcagaattcaatttgttttcaataggatctgttgattcatataactgttctagaaggttcagtgggagagtcatattatcaataccggctaacgccttcaattcatctaaattcctgaaagaagccgccattac

SEQ ID NO: 15692 - DNA, 450 bp, Saccharomyces cerevisiae
caaatcaggcaactaaaacattactcattcatgtataaagtaatttgattgttatttttaaacattatatatgatgtaagtttcttctatttaaccgcttgaattgcgtcgctgtccttacaattccttacccgaaaagtatcgcaactggaaagcgctcattaagaggaaaggaaaacagcattaaaacggcagcaaagcccaaaactactggagggaaaatagacagtccgcttgctacgccattgcccgcctgctcaattctagtgacaaatgactgtaaaagagtatactaaatcgaagttgccatgctcgatattgaatatcaaacctacagtcactaaaagtggcgaggatgcgcctcttctagtatggatccctggtaatcctgggcttttatactattatcaagaaatgctacatcatctacacttgaagcacccagattgg

SEQ ID NO: 15693 - DNA, 421 bp, Saccharomyces cerevisiae
tatataacaattactcatcccctcaacagactaagccaactgggtgcgtgaaccgtacattgatattatatagtatgatactctactcaaggtgggaaatctggcgtcgatttctccttttttttagaactacttaaatataatagattacataaaattactttctgtctttcttccatttcaagttttcaaacaaaaaatgccaagaaattcgtgtctttagcctctagttgacagaataatgtagataggcaaagttggctgaatacatccgtaatttcgggataaggattggcattgaatcgccacatgtctataatcttatttgaatcgatctatgagcggaaacgttgagcaatggtcgtacaaccattctgtgccgcaatatacctcatgaaaagagatgggattgcaaaccttg

SEQ ID NO: 15694 - DNA, 489 bp, Saccharomyces cerevisiae
tgaatttcaaagatgcaggttgtatatagccggaattcgttgcagaggcagttccaacgttgctcaacttattcttttttttggttaaaattgtgtataaaccttaaaatagcggcgacaacacttcttttttatagtttatagtaaaccccaacctgtgtacatataaactaaagaaaaactgtgacgcttttattctggtaaagaaactctgaagttacagatcaactaattcagagcgatataatgttgaagtcaataagaaggaacatcttcagtttataaacaactagtgatcttatgagctctgtctactttcattaattaagatccatgtgaaggttccagaaaagacttcctccaaaaaaattatatgctagaatggaaaaaaacttttataaacaatattctataaagattataaagaattcttgatttttgatattctactcatgatctgcttcatgagtgtttggagcctctgctttt

SEQ ID NO: 15695 - DNA, 466 bp, Saccharomyces cerevisiae
atttttcacctttcctcttcaattaatttgtgaatatttttgttaagtatctacacttacatacgtataaataggggagaaaaaagggcttacgaatacatactgatcattactatctatttctgcacctagtttcattatgcaatttaaaacaacttacagaacaaatcttatttccacaattaacgcaacttgaaatactatcgtagccaccgcaaatagagcatgtcgtaattaggggtaacactttgaagtatcgtttattgtaaacattgtggtaaatgacattcttatccatcaagtttagcagcgcagaatctaaaaacgaatgtaaatttctttttgaacttaaaaccttctttaacgccacaatacgattggtattcttcctctttggtttaggtagttttgtagatttatacgataattgtatttcccgtaaggtttctggtttaagcacccaacc

SEQ ID NO: 15696 - DNA, 484 bp, Saccharomyces cerevisiae
agaaaattcaatgtggtaacctcgttactttttgtatttgatatattattctcgttatataatacataccacataatgatataaaagacaaagatattttgaagtcttccgctgtgcataagggttatttatatatctattgctcccagcattgtagctaataagggcttgataattattcgtacccggattcataattgtcaactaactgccaaacccagcgctctaatagtggcgagacttgccaccacatcatatcgttacgatctgtattggcgattcctaaacaccaaataactgtcgactttaaatagcgtctcagaaataacttataagagaggtttattattagaactatcaataaaattagagcaataattttaaacggtttgatacaagttatctctttattagacataattgtccagatgtattacatgaactgagtgacttgctctaatgttgtagacactgatgtccggtt

SEQ ID NO: 15697 - DNA, 499 bp, Saccharomyces cerevisiae
tccgattgagagcgtatatacttatataaaatatctattctgtttcatatatgattattgttttacactcttatcttcatcctttcggaatttcgattcataaagctgttgaacgttgtatttacgatatttggttttataatccccatcgactacacacattccgatattgctcttaaaacattccactagaatcaatttatcatagttcttcaagtccacagtatgattaaactcagaaccctctttattgaccagcttcacaacttgattaatgatgtccattctttcaatcgtattgaaatttcttcttgtcacttctacagcaaatttataattttttttaacattcgaagggtcatgaaagtgtggcccaataaccaaattggccaacttgattaattgctccatttttgcattacaagagtacgtaataggtgttaatttctgaacatatctagtacgtttaaccatatttttgggatccgctaagtctttc

SEQ ID NO: 15698 - DNA, 401 bp, Saccharomyces cerevisiae
gcaaagaaataagcatcacataagtaatgtatatacatatttatgttatttctcaaccagtaccttttgaacaatatcttttataagtgaatggtttgctttctgaaccagtcctgtgttcgctgccttgaatcatgtaaggatagcagcttatgacatgtatgtctacctatagaactttgactgtaaaagtttatcatccattacccggttttgtaattttgacaatttatattttattgaaattggttcaaatagtgactacgagctggaaggaaaatattcaaagttacaaaaggtacttgaaggataccaaagtttgtaattgtattgcactaatttgttgagagcactatagaaatgtctgatttagatgaggatttattagccttggctggtgc

SEQ ID NO: 15699 - DNA, 454 bp, Saccharomyces cerevisiae
gtcaaatattgtgttgcttatacaggaaaagtcaaggtttcaaactacatatcattatttactgttaaaattcacatatactaatacatacggtaatagattgaacctcttctgtgctcttctctaaaagtacttctgaacgtatgtgtcatttttcctttcagttttctttgtagctcgcattgatgtagccgagtatatttaagggattcttatgcaatgatgaaatatttttcacctataacgccgactactgaaaacagagggccatcttaaccgttttgcattcagtaacccatactcaggatttaataaaagaggaaagcaatgtctctactaggcgccaggtccacttaccgttggttttcaatcgctgcatcaattccgactaagaatgctattggcaaatccacgtacctcttagcttcaagaaatcaacagtaccgaggcatca

SEQ ID NO: 15700 - DNA, 410 bp, Saccharomyces cerevisiae
tcgaccagcagcttgtatacctacatacttacatatacactcctaacagatttttttttgtatgttgttctttcctctgtggtggtccagtcttttgtctctttttttttttcttcttttttttttttttttttttttttgcagcattatgatagaacaatagggctcaagatcgcaccaaggctaacagtaacggtatacgcaatcgtagtgaaagtgattttcaatcaagcatctcatgaatcggcgtctcctggtacgttctatatcttgtttccaacctttgtcgagaataacttttggaagaccaaacacgccatttcttagaaagtatgctgacacatccactgctgcaaacaccaacagcaccatattgcggaaacagttactatcgttgaagcccatttctg

SEQ ID NO: 15701 - DNA, 462 bp, Saccharomyces cerevisiae
aagactgagtaaataaagtattgtgattttttaaatttttaagtgtcgttacttttatctctttcccgaaaatatttgaatacataaaatttttaaataaatgtttttatttgttcacatgtcgtgaatgacaggtactagttatcaaaaatgaagaatatttcttcattccattacattatagacatgatgattgccgtcaaaagaccgaccaaaggggttgtttggccaattggtgccatgatagcggcattgcctttggaactcttagagctagagctggaagcgccagaactagaaacactagaggcagaagcagcagccttgatatcgccagaagtgaacttcttttcctcggccttagaagatgacttggaaaccttggcagtagtttggcttgattgagatttggaagtggacgatagtttaacagatgtggatgatgcaccatttttgcagaca

SEQ ID NO: 15702 - DNA, 484 bp, Saccharomyces cerevisiae
taatagggagattgaggatatagctgtattctaaatatatatttatatatgtgtgtgttttgccctttccttcctttcagtctttattttactttgtttttctacaatctttttttattgtttccttctgtagcctttacaatactagaacaaggaactaaaagatcatactttcctaacttttttatatgttttattttttaaataggagaataatcgataactataccactgttgtaacatattacttgtttaatttattcatgttcggtttccctagtgtagtaggcgctatcttgggcaaataactatccgttattaaccataacaatgcggggtctactaaatgaggggagggtcttggatgcacattaacgaagatcttgcgagggggtcgcgcctaaaaggtccataaataaatgaatacataaacagccacctactttcagtttgttttttgctaggtctcatagtgaacgaggga

SEQ ID NO: 15703 - DNA, 409 bp, Saccharomyces cerevisiae
aaaatgtgatcattaagagtagaggtacctacttatatatataaatatatatataccactttccttttcggtacttagtattgaatttgtttgagtatatgtgcatagcatagtgtacagacttatatattcattaaaattctgacgtataatcaaattccgaggggttcgtgaacaattcttcgtatcccgcccactctccttttaccacttttggataggttcgccatatctttctttctgtcggaaccgtctctgactttagcttcttcggtaatcgtggcgtaattaccttgcgcaatattatcattattcaacgcaacttttccggctgtctgcactttagtgcttgtgtttgtttcgtgtagttgtggtgtcacttcctgaatcttttggctccttatgctcg

SEQ ID NO: 15704 - DNA, 448 bp, Saccharomyces cerevisiae
cactttcataagatatgtgtaaaatgggttaaaaaaatcaatctatcatcaacttattactattcattttatatattaaacaataagtatgaatgcctagtataatttcttagttgtaggattactggcatgcaattctgccaactgcgataaccttatgatctattgatgttaaaacaatattgttggtaatgtatttggaatcaatcacattaagagcaaagtctggttctataatttcgacttcgacaataagtgactgatttggattaattgagatgtcgttagtcccgagaatcttcaccaattttaccgcgttgtgcgtcaaattatggtaaagaagcaattcagaacccaagtcaacgggatcacttagcgcgtgcgtttgtattgataattttattaaacgcaaggctaacaactttagtgtgtttggtaaattcggtga

SEQ ID NO: 15705 - DNA, 415 bp, Saccharomyces cerevisiae
tataatagcacgagggagggtacccgcctcgcaaacttattgataatgataatggtatgggcgttgatatatacatatatatatatatatatatatatatatatatatacataatatatatatgtttatctgtgtgtatctatgtggacttcaataagtgatcgccttcttgatatcatattactcccccatttcacctgaattaatttcggaatacatgagtaagctcttggaccgaatcattactaggcttcatgactgttgaatatactgcatccgatttggcaacctatcagaatgaggtgaacgaacaaattgccaagaataaagcacatcttgaatcattgactcatccaggttcgaaagtgacatttccgatcgatcaagatatttctgctacacctcaaaacccgaa

SEQ ID NO: 15706 - DNA, 415 bp, Saccharomyces cerevisiae
attagtttaacgcactttacaaatgtctaattataaatactacatataatttttgtatattttaaaattgccaagtataattaaaatcattactactggtgctaccctacatccttgaccgtactgagatatcactgcttaattccggtgattgggttcttttcagttcttggagagatatacgtactaccttcctttttttttaaggatacctttactgtaaagggtttgttcctgtatcaaccccttcttcctgtacagaatctaagggaaccgtaaaagcacataagtatataaaggtcccaagatttgattaggtagatatggcctttgagttggctcttagttttttttggccttgaatacttgttcctacaatactccaacagcagttgaagccagaccgcagtatcac

SEQ ID NO: 15707 - DNA, 401 bp, Saccharomyces cerevisiae
aaatggcggagtaagatctctggatgatgatagggggctctcattgttttatagatacatattagtatactacaattaaagatatcccaatatctactttcgatattttcagggcgggttattgaataatgcattaccctaagctacgcctgaaaaatatcaaacacgcttcttgaaaagagaaacctttaaagaggtgtatagtcaactgaattggttataaagttgaatactttaacacaattgacggtgcaaattttgaattatccttttttgattatttaggatgcggaccgattggaattttttcttttgtatccttctgcaggccattttcgttgtgggcacacaaacttcaagaacgcttgttctttacgaccaatctacggaacctttagagg

SEQ ID NO: 15708 - DNA, 403 bp, Saccharomyces cerevisiae
ttatactgtaatcagcccacgttgtctttgtattttccactttttttatttatactatttaaagaaacagaataaattataactcttttttttacatatcacatttatatttactccattgcgttacaaatatgaacgcttcgacaacaacgccaaggaaaccgggataacccaactgatattttctaccatacactgaacgaaattgcagaaccaaaaaataacaaaaagttcccaaaaggaatgccagaaaaaaatgggaggcaggtccacctaacaaaaatttaatcatatgccatacttcttgaacagtgaatgagtcatctccacacctaaaaatgtggccgcattggctgggaaagatcttagtaaagcaggacctaaaccagggaaaaatcccttg

SEQ ID NO: 15709 - DNA, 410 bp, Saccharomyces cerevisiae
attcctgcttaaaagatactggtatatattaagagtaatatcacgtatatatatatatatatatatatttattcgaaataaagagcagaacaattcaagtgttcaattagtatgaatggctattaacattatcgtttctttctttttttatgatttagtccaaaatatcactattcaaatctcgcggagagaaagggttcgaaaattttgttttataatatcatgattttgatacgaacataaatatatatagaagtaaaagagaaagtgttcagaataatattcacgtcaatgaatggatatcaaagaaaatgaatggttcgaaggaacaaaaaaatcacataagcaatagaccaaccgcacaacttaatatggacccatttggaatatagaagcgtgcaaaggatgtt

SEQ ID NO: 15710 - DNA, 489 bp, Saccharomyces cerevisiae
cgttaagactgcattcatcacatatatatgaatattacttatattgtatataaattttgttttctcttaactttgtatccttaataaaataaaattcacaagtatcacaattaaaatatttgtttttctttcgcgtaaatatttagcttgataactgttactgatatgtctgaggaaagttgatcaagacccaataataatctatatactggttgaaacaaatcagtgccggtaacgctttttgtatcttgagatggcgtatttctactccagcattctagttaagaaaaagtctaaaaatggtttttttcatccaaaatattaaattttacttttattacatacaactttttaaactaatatacacattttagcagatgcgcgcacctgcgttgttaccacaactcttatgaggcccgcggacagcatcaaactgtaagattccgccacattttatacactctggtcctttaactggcaaaccttcgg

SEQ ID NO: 15711 - DNA, 400 bp, Saccharomyces cerevisiae
gctgtttaggattgcctttttttttaacatgtagttagtttttctttatttgaatattctaaataagaaatatgtgtaatgctctgccaactattttgcacaggaaagaaaaatcaccaatacaatactactatattttacccaagttaatacgggaaagtatattttcttttccatatttttcttttttattgacgtttgcattttttagagcaactagtaaacaaaaaaccagtcaggcccagtagattaagtattgtcattacatagacaaaggcaagagaaagagagcattttctttcggtctctagttatgtctgttaaagagcataacgaagaagatattattggtgatgaattacagaattcgaggcaactctccattgattgcgactcagtt

SEQ ID NO: 15712 - DNA, 478 bp, Saccharomyces cerevisiae
tttgaatgccatgaagtgtagctgctggttacataaaatcgtcactagctttacacattaaatattatatacgaatttatgtacacgaattcaagtccgtaatttagtcttctgacttcgactcccgatcatcatgcagtgttttcttgctatcgtcttcctcttcaccagccaaaactttatgtttattctttgttgcagctttgacaatttgaacaaaggcatcctttgttaatgcagacttcaatttcatttgctcttctgttagttctccccctttcttctgagattgcagacgtaaatcatccaacgaatgtgtgacgccgtccagaagactttcattgagggaattctcttctatatcgttatcgccatcgtcccctaatgaatacatatttcttaacctcttaattctattattaagcttcacaatttcaatagcgtcacgtaatttcttacgcaaagaaaaccctttctt

SEQ ID NO: 15713 - DNA, 419 bp, Saccharomyces cerevisiae
tgcaagactcttacgaaatattaaagtttaataccgtgtaactgcctcttacatatgtatgcatatatacgtacgtactatatttttcttgtatatcttttttattgtctgagagaaagaacatcaaaaaataaaggaagatcctcctcggatttagcatgcttaatgccgaatctttaatacaaaacgaatgatatttcaagtatactaattagaaatcaatcaaacataccaaaagggacagtaaagagaaaagcaggagctctcttttaggggaaaagtaaaatgtgattagtatttcgttgcgtgtactagtcaactcttcttgtcattcttaaatttacattaattaccccaattttgcatcttcgtatataagagtgttccccttataagctttctcctgcacatacctgcag

SEQ ID NO: 15714 - DNA, 481 bp, Saccharomyces cerevisiae
aactaagggagacaaaaacttcttaaaaaagtatcttgtgaggctatcttgataacgtaacatatatttctaaaaagttatatatgctttttgtatttaatttgtttttctttttacattcctattattcttcaaagtccaaaagactctcggcacgaaggttgaaataccctatactaattgtttgctttgtctttttgtatatatccgaacgtatctatctgaaatttttcaaatttataaaaaataatatatataaaaggaaaaaaaaaaaaatcgatgccctactaatagagattggagctgaaaagaaaaagtgtacatcaaacgctatatctcgaggtttgggatggttgagtcaaatgatattataaaaagtgggctggcagagaaagcactaaaggctctaattttacaatgtgaagagaacccatctttaaaaaatgataaggacatacacataatcatcaacacgggcaaa

SEQ ID NO: 15715 - DNA, 439 bp, Saccharomyces cerevisiae
tgcgatagcacacgttggtatttacgttgcttgaccgctctaaaacatctgattgaaaagaaaaagagagaagaaggaaatgatttcgacaggtgacctttaagttcgatatacctacatattggctatttcttttatttttcattttctataaaatatctatataagtatttttataacgatttactaacaagggcaaaatttcaaaggtcccgtgctcccagtcattttattggctggcgaataaacggatacagataaacaaaacagaagcacagaaaaggatatccacccatcatgataagcccaagggtgaatactcgagtttggcagagatcaatttctcttttgagcccacaagcggccaagacggagagtaatgtcgtaactaaagaaaggacatatatcgagaacttaagcaaggatattgcgacttccc

SEQ ID NO: 15716 - DNA, 429 bp, Saccharomyces cerevisiae
tagataaatacaaacttcgttttccttttattttgttgttttttttttcacaaactgtggaagttcgattaactttagaagtttgtttgatcaaaaatagactgatcctcacacctttcgttactatttgttactttgctgtatatcgaataaataaacctgactaaactccttctgttatttagcgcagatcctatatgctgcatttttagatgtatttgagcactactatcgttaatgccgtggcattggctatggaccagttaagtcacggcctttcttagttctatcatatacgacgttatacttatttactttcccagcgttgaaattaatgtgtctttttcataatatttactttttggtgcggaaatctgtaatattttaaaacaaaatctcatccttttgaaaagaaacgatgaagaaaaa

SEQ ID NO: 15717 - DNA, 432 bp, Saccharomyces cerevisiae
cgttgttcttactaaatatttcaacgtgtgtctttcaatttttattatctaatatttatctttttttaatattatagtataatttatttaagctgagatctgctttctttaatctttcatatgatgaaataatagttctacataaatctataagaataataaataaagtaaaacaactgcaaaaaacatcgatgtcatccaggatccttgaaagatttcactctggagaagaaaaaagatttctcatttctcaacgaacagttagatgcattcccttccttatccactacaattgaacttagccatttcaaccgttgatatctcttattgccttgattcttgatttggaattcttcgataaacgtatacttttcatctgaccttgttatctttaaatgaccaaaatcataatcaaatccgaggctccaataa

SEQ ID NO: 15718 - DNA, 478 bp, Saccharomyces cerevisiae
aggtagaagagcagcactattttttcatgtgctgaacttcaggaagcgccggcttatataaatgtcttatttaaatgtttgtgtatacatctcaatggattttgaattttaacatagaatgcgaatgcacagtaacatagtacattcagttgctattttccgtataagctttctttcccttatagcatacatagcctttgacgtattgccagccttttcaaagaaatgcgaaaaaatagtgcattaccacctacgtaaggtaggctggagaaaaagataaacttttgcattctctgctcaccataccgcgaaggaaagtagttataacgtgtcccgttttcaacaaggttttctggtatattgttaacggtggagaaagcatctagtatcaattacttccagagtacacacaacgaatgttatgtctgtccaagatactaaagcggtagagttttctatgggtcacatcagatcatcc

SEQ ID NO: 15719 - DNA, 429 bp, Saccharomyces cerevisiae
gaaactgtgtaaacaaaataaatataaattataagatttgacatgtacacaatttattaatatgttttctctttattattaatataattaattattactaaaaaaaagaaggtgacgcaccatacagaacttgctcttttgtccaatactgtctttttatggttgttattttttacgttaccgatttcggtttctattgaactgtaataacttgcctatgtgtctatatgccttttctatttagtaagagctatgcattatacgtggtcattttacttcttcaacagaggaagacgcactaaaatcgcttgtagtgcctccaagtttcctgcttgagtgatcgctatctgcctcctctgcgtcattaaccgcatctggctcttctatcactccagtttctttgtctgtttcctcattattaccctggcg

SEQ ID NO: 15720 - DNA, 478 bp, Saccharomyces cerevisiae
gcctccgcttaaaaatcagttttttaattaaatgatttatttatctcttttaagaactattaatcttagttactacgatacatgcacgccgctcatctatatatgtgtataaatagcgtatattcacacacatatatatagagcgagagagttttcttgttacttttttctgtgtttcggtacctcttgcctgtagctgcttcaaaactcttggcttattgaactctgtttcaactacagacgaaataatacgaataattgatttgtcttgatgtaaaaatttaaaagctgatacaacaagtcatttagcacttgatctgaacaaacatcatattcttatagttctgctattataatctattaatatattaatatattaatctcaatatacatatacatatacataaatgggtaaaggagacaatcatcttctaactactttgtacttattttttggtggcttgaacgacttttctgc

SEQ ID NO: 15721 - DNA, 412 bp, Saccharomyces cerevisiae
gctctcttttgtcgttggttatcactctcatcaaagcatctctgtgtctatgtaattgtgtatctatttataaatagtaactaagaggtaaggttgtacacaggttggtctaaacaccctcttgttaagcttccgcattacctgcgagctggtaattgtaatacagatttatttgttgatataatgctatgaaatttcaactaccgtcattgagcttctcaataaagtcgttacgtacgaatgaaaaatttgaataatttaaaccttcgaaaagatctttgagttgtacttattaaacctgaagtagatcattaagacaaacaaagctctgactgacaccaataactcctacagtgatgacagctatcttaaactgggaagatatatcccctgttttagagaaaggcacccg

SEQ ID NO: 15722 - DNA, 429 bp, Saccharomyces cerevisiae
tggatccactttctggaggaattatcgaaagcaagtgttgtcttctatgattatgtaccgtattttcttataagaataaataaaaagctagttcagttttagtcgactaaatacgcagagagattattaattattggtatatgttctggtttaagttgctcattctcaactcgactgtgtatagtagcttctttctggtataatctatcttcgaggagaaaattatagtttacaacttatgtaaaactgctcaagttccaaccgtatagaaaacgcgtggctggtagctttatgttcggatttgagaaattttcggggaaataagtaccgttctaatttttcagcgcaaattaacatgcggagaaactttaaactgaaaatatggccacctgcatgcgtccatatgaaagggtcatcaaatagcctcga

SEQ ID NO: 15723 - DNA, 498 bp, Saccharomyces cerevisiae
tggacctaattattcagttatgggtactgacatctctgcgattttataaatatgacatatagatatgcagctgatatcgcaaaaataaaacattatatgaagttgcgagtacgtaaaaaaacccgtgtttctttatgaggagattgttaattgtagatttatttttttttatttttaatgtatctatataatgaaataaaatgcaacgagaggttatgtaatttatcaaaacgaaaagtgtttgtataataggagaaaaacaattctattaacaaggtaacgcgttctttatctgcttttgcagggcaaaataatttaataatgcctcataacaagcgatatattgagttagattctgtaccattgaaatcctttgctttcttaattcattcactatgataaagataaggtcctgagtcatattccaaacatcaatcttgtttgagtgatttgttgtaggtgaaagaatacttagtaggaaatccaaggtaacgaaaa

SEQ ID NO: 15724 - DNA, 426 bp, Saccharomyces cerevisiae
gtaggtttttagtccataaatagtttttataaaattcgatcaggttgcccttgctcgcataagaattttatcaggctctagactctaagataggaggcttgaagcgattttgttgttgataagtgaagttttacactattccatattgtagtttacttttgcttgttacccagaatcgcctatatattcacttttgaacgtgacggtaattttgtccgccaagttaaatatcctttgggtagtttgaaaaacttggatatagttagaaaaaaaacttctcatttatacacgtagacaaaaagacggtatggttgataataggcgtacgtttacggcaccccaaagcttacttgaaacaaatcttacttttccgaatgatgaaccgtcacttactacaatcacagttacgcgagaaagatgtgttga

SEQ ID NO: 15725 - DNA, 497 bp, Saccharomyces cerevisiae
agatctgcgggagtgatgaggctagtagtttttcttaacggtcattaagtatacatttacatatttataccttttaataaatgacaatgccttttggctaaggttcttcagtaaacatttcctctaatgtatccatctcctctgggaagtatgactcacagaattctgttaaagacggcaagacgctctgtgcaaattttttgtctatttggggccatatttttctgacaatatattgcctcttgtccaaatatgacctagaagtgtcgaaataaattaaacggcaataacagttccagaacataccgttctgtaggtagtactcccaaccaaattctattatcttttgaaatatgttcttttctacaaattctacggtatccttcgaataaaactgtactaagttattcaataaaatttcttgaccactttttttttctttacaactcaaacgtttccatactttatcaaacagctccttattcaaaagcccgttt

SEQ ID NO: 15726 - DNA, 491 bp, Saccharomyces cerevisiae
taggtgcatccttgtgattttttgctcccgctatcttacccttaccattctggttttatagtattcgttgagtatcgtttcatctaaagtttgacaaccacacgcaaatatatactgtacgtagacagggttaatgttatttatgtagataagtaatgttcctgagaagacagtttaaataaaggatacggattgtttaccaaggcggataactaaatttagccagtattaagttcaatgttgcgtagctatttcattattttaatttatgcagtctgtcatcttcttgaggaacaacatttcgtttgtatctttcaaaaggatttaagttatcgtcagcagcagaaatatctcccgaataggccctctccatttcaataggtcttggttcgagcgattttagtaatggctttttctttgggaccactggtggctttttcttcaggttatcattcttttttgggacaacaggcggcactttctttggacta

SEQ ID NO: 15727 - DNA, 450 bp, Saccharomyces cerevisiae
acgagagggagcgtcttaatggcaaagaaaggtatgagaaggaattttcccctttcaacttcttgcttctgatctaattttattacctatgtactttctatgtattatcaaagaaaaactaacttcggttcccttatgatttgatatttttctttcttatttacaattagttttctcagaacgatattcaatacagttctccggatttttgcttactatattggccccaaaaaaatgaaataaaaaaagaaaacaaaataatatacttgggtgaaataaaaaaaataaatcaatagcacccagttaacctagattcaaagtttcttcttcaatctcaatttatatacacgtttgagttaatgggaaagcaaagtccagctataaaacacttgaccgttagcgccataccctccaacaactaattggaccttctccttctgcccaaacagt

SEQ ID NO: 15728 - DNA, 425 bp, Saccharomyces cerevisiae
tttacccgatgctggttttgtatcgaaaaagattttcaggttttaggttttattttttgtctatttttaaatatataatataataaaaaataaattgtgtctaatatccataatttgtacatttagattatttcttttggttctttattctgacctatatagactactcaacacagtcacttcatgtcatccagatattacttgcgttgagcatctcttttgaatcctcgcttcgggctctctcttagtgaaaaattaaccttacgccaaaatccaagaagtaaaattaaaaagaataatggtaaaagtctaacttcacatagagaattcaactttgtataaaggggtagccttgttctctatagaaactgttctttgaagtactgctaactgaggtaaaaaaatcggacgattttgtctttacg

SEQ ID NO: 15729 - DNA, 421 bp, Saccharomyces cerevisiae
aagctcaactgaaacagatgtataaatatcatataatcgtattgttttaaatcatttctttataccatctatatagtactactagtatttaatggtgccgttattacccgcgcttgattttcctttttttttttgatcaaaaggatggaacaggctgaaagtaaaccaaaaggatcaaagtgcaagcaaaggtgccacagaaaagtttatcaaaaaaccatacctagctgtgagagttttagactctgttttggtgactgcatatctattcataaatcgacacgaacttttcgtgcaggatacataataaaaatagcatggcggtaaatcctgagttagcaccgttcaccctctcgagaggaatccccagctttgatgatcaagctttgagcaccatcatacagcttcaggactgcattca

SEQ ID NO: 15730 - DNA, 425 bp, Saccharomyces cerevisiae
aaatcttggaacatactgtttctttgttttgactttatactttctatttatattttatttttataactggttaagtacacataggactgcgtatcaaacatataagtgaggcaatccacattttttttaaagattcgaatatttttattctcattagcgtattccgagaatagttcgaaaaaatataaggtatatcaagagtttttacaagtgagaggaaagaggaataagctataagcaacaaaagcgtaaaaaaattagctgaagacatagaactatggatgttctcaaagaggtgttgtcactagaccaagataaatttgaccagctgaaggaaacgagccgagataaaacaaatgaaacggatgatccttttgaaaactatttgaaggattgtaaatttaaagcgccttcaaacaaagatc

SEQ ID NO: 15731 - DNA, 438 bp, Saccharomyces cerevisiae
tcttgttaatttcgaaaatgttatatatctttcattcatcaataaattaacttttttttttttttttccttgctgagcttttgatctattcagctatgtgccctgtcatgttaggaaatacaaatattttttaaaaaaaaaaaatagtgtgtgtttacaaaaatgcgaattctgtggatcgaacacaggacctccagataacttgaccgaagttttttcttcagtctggcgctctcccaactgagctaaatccgcttactatttgttgaaattctgatgttaaaaagataactcatttgagtgtttattggcgtcaagattgagataagtcaccaaacccaatgaaagctgaaatgcaaggtttgataatataataggataatgaacgacagtatgtaaagataaaagggagataataccccttgaggagaatgtctt

SEQ ID NO: 15732 - DNA, 424 bp, Saccharomyces cerevisiae
ttacatatctaagtacataactacacaaatacatactctccgatgtaaataacgtaagaaagcaaaatcgtctatgccaaaaagattcaatgccgtctcctttcgaaacttaataatagaacaatatcatccttttcataccacaatcttagaccattcctcctcagtgtagcacttgcagctaaaggcatgaatctcctgcagctcttctttcacagccttgttcactgcacgactcctcattagtttgcttttaccttgaaagaagtcgctgaccaccacaatatcaaacgactgaccacaaccgtacgaaagatccgtcacaatgatatggtaaacttgcggtatggctgattctatcctctcgcggagtccctgttcagtaacgggcatcttatagtgtcgttggcgctttgtttctctc

SEQ ID NO: 15733 - DNA, 488 bp, Saccharomyces cerevisiae
aagtgcgctttgacgagattttaggatacataaataaaaagactatataacatattatttgtgataatatctctcatttctggggaatgtaccccacaggcaccactgtttacttttgtcgctgatatcttcatagaatttttctttattctttggggtattcttctcggtgtaatattcaatgaaaaataaatatcgccagtttctatcatgttcgtccaaatggaatggtctagagtttatagaacacatgttgagtgaatggatttttagtatgttcaaaacatctaccaaagaaccagggtcatcttgacgagtagtaaaggtgagtaggttaacccgtagtaatccagtgtcttctacttcattgtcgcctgcgttctcccttctcttcaatactaaaaatcttgttgtatttcctagcttatcatttatcgaatgttcaatgatgtacgccttatgcaattgggcagctgtttcactagcaa

SEQ ID NO: 15734 - DNA, 490 bp, Saccharomyces cerevisiae
taggcttctttacattgatacacaatagactgaagatttatgtagttttctttgtatataaactctagataggaaaagaaaggtcaccattcatttataataattaaagacgaacagacaatgctgatttgtttatagcgcctacaagtaatggcggctgtctgattccattgtctctttctaagaaaagcgctgaaaattttctactggaaatttcagaatatgaaaaagtagtagagatgagggccacttaaacacaataagcatataaggaaccaagggaaaagcaacaaatgagtgctaacaatggtgtcactggcaaactctctagtagagtcatgaatatgaagtttatgaaatttggtaagacggatgacgaagagagttccaactccaatacgccgtctaatatcaactcagatgtggaacctatagagcagaaaggtaaactctttggtctggatgactcagcgtgggacctcaatagcta

SEQ ID NO: 15735 - DNA, 434 bp, Saccharomyces cerevisiae
gtattagaagagttgttagttgtacttttatagctctcttgttacgtaagattgcggcactaagatgcggtgccaattttttttttttttctcttgatcaaagcagctagctgttcatcaagatatgtaacgtttttaagcactgaactaacaaggggagccagtgaacgactatgtcttcacaagatgttctgatacattcagatgatccgtgccatccagcaaatctcatttgcacgctatgcaagcagttttttcataataattggtgcaccggaactggaggtgggatttcaataaaagatcctaacacgaattattattatctcgccccatctggggtgcagaaggagaagatgatacctgaggatttgtttgtcatggacgctcagacattagagtatttgcgctctcccaagctttacaagccaagc

SEQ ID NO: 15736 - DNA, 417 bp, Saccharomyces cerevisiae
gatgttgtttggcttatggccttcattaataagtaagtgctatgaatatattacatatatatatatatatatgttgtgtacgagagtatactcgtatgtaaattaacatcaaatgtgtatgtggaaatgcagaagagagcaaactctcctttaaaaaacaacctggttcctataaaaaatgtcttcttccatagtgccaaatgtatagttgctgaactcataatgagcttcttttattgtttcatcagaatgagaactattttgatggtgatggtgatgatggcgacgatggtgacggcgatggtggcgggaatgttggatatcgtttatgttgatgagggattcgcggatagtcccctttgagtcgatctccctcttcatcacggcttggttaaacttcaacttcctggggaattg

SEQ ID NO: 15737 - DNA, 423 bp, Saccharomyces cerevisiae
gtagattggattatatctatcaacatagtttttgtaccatctatatactataaaaaagttttttgctttccactagtgcagacgctaatagtgctgttttgttagtggtatgatatatgtcatatcttcattgaataacctactcgagtgcatctgtaaatgcacaaacatgtattatcaattgagctgtagtaatttaggcataacaaaaaggtgcaagatctcatggcacctattcgttcgtaggagatttattgtcacctttttagttttacaggatcgaaaaaatctatggtcttgtatggtgaatgatctatatgtcttctctttgaatttctagctagctcatcaaagccgctttcatttattccagtctctttactcacggaatattgtttagtaacatttcgcatgcttttctca

SEQ ID NO: 15738 - DNA, 470 bp, Saccharomyces cerevisiae
taagtcaacgacggggtgcgttcttttattcttggccacttttatttatatatatttatatatacctaggtacagtataactaaacttaagtagaaaaatttaaaaagaaactacagtttttttttatatttattatgacaatatttgccattttcttgtaggtagataagggaaagattcagagagtaccatcatcccggtcatttcatttaaataacatatttttgttacccggagagtcacaatacggtccacccatttgtttactacctcgaagttaatacagatagaggtacatagcaacaatggatgaggtaacttgcaccctatggacgaataattcaagcgatactagtgctacgtatactgtatggcagctgatagagataattttttacaaaatattgaaaatgattcaattaacaatggccaggccatggatctgtcacccaaccgaagttcctctgaa

SEQ ID NO: 15739 - DNA, 490 bp, Saccharomyces cerevisiae
ggtaaaatgcgctttcaaatggcctcctcactaggtatatgaatactgttgtagttatatagatagtttaatatggcttgccgcccgtttagaatgatgcattaccttatataagacctatgggggtctcaaacagtggtatgacgacagataatataagcactagttcagacgagtaaacaatgagaatagtgccagaaaagctggtgttcaagggtatgtttgacgagaattgctagtgtgcgggaaactttgctaccttttttggtgcgatgcaacaggttactaatatgtaatacttcagctccccttaataaacaatcaacagagtatataaagctcgagaacgatggtgaaaagagagttatatttaaagtgaggactagtgctcccacaaagtattgtgtgaggcccaatgtggccatcataggtgctcatgaaagtgtaaatgtccaaattgttttccttggattacccaagtcaaccgctg

SEQ ID NO: 15740 - DNA, 494 bp, Saccharomyces cerevisiae
ttgttaaaattctcacatcatccacctttttcctactctcattttctttttttgaaagttgtttgttttatataccttagtttcacaacaacataaggcatgcctatttgagattttgtgattaaaaaataatagaatacgtactatataaccgtcggtttaaagtaaataaattaaagactaagaatgaaacaattaaaaacactgttcaataacgttgctctatcctcctgagtcttccggatcctgtctccatttttttgtgtggtgacgagttgagataaaaagatttccactgctgagaataatatctataatcgataatgaaagttagaacgatcacgttgactctgaaatatagtcaatagaaaaaattaggtatcaattcaattgtaatatttactggattgaatttaatttaagaattacagaataagaggacggacaataagaggtacgctacacatctaccatcactttcagggagggcataa

SEQ ID NO: 15741 - DNA, 484 bp, Saccharomyces cerevisiae
agagattttcgagtaagtgtcggattatctcagatccggttttgattttaaatctgttactaatcgaaatgtgtatttacgtacgtgagataaaattatctatgcatatatataactcaaatggaaaatggccacgtattgctctcattctcttcacttgcttacacaaaacataaggtgacaattaatggaattttagtttttcaatttttcaggggaaagaagacacccaaaaaaaaagtgaaaagtcaaaacggtaaactgtttatggtatttaaatgacattaatagcagcgtaaagagtcattttttcgtttgattagcaaaactctgaacattaattactacacctatagacatatctttaaacagtgaaatatttttttcatttagtaaacaagaattaaactttgaatatttttttttcgattaacttatgtcactttagcctatactttcttcgaacatttttcctttcattttg

SEQ ID NO: 15742 - DNA, 406 bp, Saccharomyces cerevisiae
taataagatctcgatattcattgctcttttttgtagttttgcctttaactctcggttttttgaatttatcattttcctgatgacctttgactgctctttgatctatcctgaacacaagaaaacgaaaagaataaataaaagtagagatatttattatttagcctgtaccgatcactggaaactggattctattaattttacttattcaaaccaagatatctttttcttttttttctttttttttttttttttcagcagtacattcctgaagtgtacacttgccttgtgtattaaatgatgattcgatattataaaacaccatttaagtcgtcattaatttcaatatcgctttcgtctacttgaaacaatttaccttgacttcttattttcaggaattcattggcaa

SEQ ID NO: 15743 - DNA, 400 bp, Saccharomyces cerevisiae
tagctatgaatttttctttataaaccgaaatatagttatacgctttgagtaaagacacaggttatcaattataacgtgaaaggttttgcaactgtcaccttgtaaagctgtacacactgaggacttcccatcccgcttttctcgtttcaataagtttcacattccatttgtaagtatcgacaaacctcttaatgacttctttaggcttatttcttgcacaaaataatatatatgcaacaccatctggagaaagaatttgttctaattgtcgtagcagtttatcagtaatcgccatcccgtcttttccacccaataacgctaaatctagccattggtctgcctcctctcttgatcctgggacatctggcacacattctgctggcacatatggtgggttaaa

SEQ ID NO: 15744 - DNA, 416 bp, Saccharomyces cerevisiae
tcaatgaaagtaaataaaaaaaactactaatcatatatacatgtcttgcatacgcacgtttgtttatattatttcgagaaatgtttttttgaaagttcttcattttttcttcttttggatgctgcaatcatttcttgttgacgtcttcttttggccttatccatcttaggcacagtagtaatctgctttctttctttatgcgctttaccgttttttatactttctttctcctttctggtcattttagccattttatccatccactcagatacttcacaaccactttgtttcatgacatttattattggtttaatagctactgagtcttgtttagtatagaatgtgatagctttacctgaccgcccacctctacctgttctaccaattctgtgaacataagcctgagacgatcctgg

SEQ ID NO: 15745 - DNA, 480 bp, Saccharomyces cerevisiae
gacattcctatttatagttgaatagtttattaatataggttaatcagtcataaacaaatttgtacccttttttttgaatcaaagtactttttttacgaagcagtaaaacgtttacgagattctctctacatatgctctttcgcgtgtagcgacattttaccattaggtgagaattttgtgttacaagctggatgtcaggatgatacctttgaaggcatagttaaattggctgggaaaggaacggaaccttttcctttccgagtttcggccagatatttaggcttttttttttctgacggaataggggacccaggattgacaaatataacaaaacaagcttcaacgagacgtttatctcgagaattacgtctgacagttacatgaagtgtgagttcatgcaatctgtacctttattgacacagatatactaaaagaagttacaatgggctccaaaaaactgaccgtaggatctgattcgca

SEQ ID NO: 15746 - DNA, 402 bp, Saccharomyces cerevisiae
gataattaacttttgttagttttttattaataatatatcattacaagaaaaatgaaataaaaaaataaaaacgtgatccgtacttatttttgtgttaagtatcaaataatataatatataaaagaccgtgatacaatagaaatctgcgttacgttgaaaacgtcataaaggtatctttgggatgagcagttgttattgttcatgatcgttacccggcttcaagtggattttcacgaagcctatgggcttgacatttacatgatatcacatctttaagaacaagggaaaaccaaagttaaaaagtagcataaattcctcttagatcgctgcaaggagattagatcttccctttcttttttgaaattttcttttttggtctagagttggggtgatgatggtacc

SEQ ID NO: 15747 - DNA, 470 bp, Saccharomyces cerevisiae
ttcaaaaattaacataacataatatatgaaatagatgtgtaaaacgctatgtattaatacaacatgttaatttgcttaagcataattatgttctgttgaatttcaaatataaatgcataatatcgcctctattctcgtccacttacttacttggtctctattaaagagactgaaggaatatacataagtttatattaacgctcaaataatccgtcatcttcgtactcgtactcgtcggtatattcactatcatcagaatcttcatcgcttctatcatcactgtcagtttcttcggcgatttcactttctccagcaataacactatcatcatatattaactcgtcctcctcatcttcatccaaataaacgttggccagtgtttcacctttaaagttatttttaggctccacaacataatggccttcgatataacaattgctgagtttacactttgaaccgatttttgccat

SEQ ID NO: 15748 - DNA, 420 bp, Saccharomyces cerevisiae
tacacgcgctcgtacggatagatgtttatatatattattctttttacataatattgtaaccttctgtatgtaaatccgaaaacattctatttctttttagtatctattgctctttataagcttttcattttacttttctccgcggatgatacaaataaagaagctgtgttgtatagaaagaaatatatggcggcaaaaaaagcgttatcttctttctgttcctatttcactgagtgctactggatggtcgtcaagaaaggtgaagaaatcttcaaagcaataagaattcagacattgacgttaaattagattatcgccgcagctgtaattgcggttatggcctctagtatttagttcgatgttaatgaaataaagcgcaagctgactgtgaacgataaccgccaggaaggctagacacag

SEQ ID NO: 15749 - DNA, 416 bp, Saccharomyces cerevisiae
cacacaaggagaaatctgcataattacgcatatatatatatatatatatatacataaatatacataaatatatgtatgtatgtatgtatgtgtgtatgtatgtatgtacacacatgcatggtttaaatagacaaaccttggtggaatttatacttttttttggtgacgaggacgtccgtaagagcatcgtcgtcaacaaaccatgatacacgaccagcagcaccttcgttgacaatactgctaggtaggcccttttcaggcctttccataatggtcttgatgatgggcgccttggttgcaccttcgacaacgaaagtaaccctgtgagaatggcagattacaggtatagtcagcgaaattctggtcgagggcccactaggagcgttctccacgggcaccacccatgcaagtttctc

SEQ ID NO: 15750 - DNA, 494 bp, Saccharomyces cerevisiae
taaccgctctgcctggaacaatacagcaaaaattgaaacgaactattctctcttaaattatatgtatatgtataaggtatgtgtatgtatgacaatcaattcttataactaactcttcctacctatatcggagtatgttgccaggcttgccaactagccaactaccgcctaggttatgcctgttaagttgacgccgccgggtaccgccccctgtttttcccacgtttctttctttcctctaggtaacggattttcggcttattttccacagcgagaaaattttctttctcctgcactttttttcatattcaggtcctttgatccattcattcattcttgttttaatttcaatctagattttagttttcggttgaatttatctttagttttttatcaataagaattggtctagcttatctttccaggctgcttatagtttactttttttaaaaaattatatttctatccaatatacaaatcggaagggaaattca

SEQ ID NO: 15751 - DNA, 479 bp, Saccharomyces cerevisiae
atgatatgtgaataatcatgcgggatatccgatttttatgaagcaccttgcggcttggccttttttcgaagttatgttagaataaaaaaattttaataacacacattaagtatgtatgtatatatactgtttcaagttcgttggtcttcctttaattgtttgaaacggttaaaagtatctaattaaaataaatatacccgaaatcatactaaaaaaatagttaatattaataaaagtaatgataataataataataacaataataataatacgatgatgatgatgaaacgaaaaactgctacattgaagtcactgagaaacgtaatgaaaaaaagtcctttttactagccttttgaaggagaaagacaattatattagcttttcatagataagttataaatatgctatacacgataactaatagcttttttctggtttgaaaccgagcttataataggtaagaaatcaaaccaagggcc

SEQ ID NO: 15752 - DNA, 427 bp, Saccharomyces cerevisiae
gagcatgcttctctttttttttgtaggccaatgataggaaagaacaatagattataaatacgtcagaatatagtagatatgtttttatgtttagacctcgtacataggaataattgacgtttttttttggccaacatttgaaatttttttttgttacctcgcgctgagcccaaacgggctccactacccgccgcggtcgccattttgggaagtcatccgtcccaaaaaggaaatagccataacatatcgttactgttttggaacatcgcccgtttcgcccgattccgcctcagcgggtataaaaagagatctttttttttcctggctgtcccttcccatttttaaatgtcttatctgctcctttgtgatcttacggtctcactaacctctcttcaactgctcaataatttcccgctatgcaaaattc

SEQ ID NO: 15753 - DNA, 423 bp, Saccharomyces cerevisiae
atacaataactttatgtgtcacgttcctcaggatttatgaattaggagatttttgttttatattattacatactatacagtaagtaaaatgaataggtccgtttacagccagtgcgacgtagcatctttgtaaagagattgccaaataaaggcttcgctcagaagcatttcaatatccgtttcagtccagtcctttgtaggagggttctgtaagaaagttatagtttcttggaaatccatttccattagctggtcactccacttgatgaggaatgcagcacaaacaaacacatgaaactcattcaacgaagactgtctcatttttccactgtcttcaacagcattgtttggtgtcatattagaaagagctgtggtgggagattggaaatcttttgttggtgtaacaaaacttgccactcgagg

SEQ ID NO: 15754 - DNA, 453 bp, Saccharomyces cerevisiae
tctctgaataagtactgacactcacaccagaatatatatatatatagcgtaatctttaatacagtaagtgtgcaataggtaacatgacattaccctgcagcgatttaacgggcgtcttggagaaaagaagagaaagggaagaaataggttgatatattgagggcagagaaagtgatagcccaacgttggcaaagatataacagaaaagacgttataaacaatacaggaatactaacaaacgtagcgcagatatggtgacttctaatgttgtcctagtgagtggtgagggtgaacgattcaccgtagacaagaaaatcgcggagagatccctgctattgaaaaactatctgaacgatatgcatgacagcaacctacaaaacaactcagattcagaatcagattcagactcggaaacgaaccacaaaagcaaagacaacaataacggtgacgacg

SEQ ID NO: 15755 - DNA, 410 bp, Saccharomyces cerevisiae
gccatcataaataaacaatgacgaatatataaatactatatgtatacatatatcaaactgcctttgtactttttatggtcctattgctccccgaatctttagatcctatatgtgctcttgagtatcgttggaggattcgtcaactcgaggtacgagatatgctttgtctcttccttgtattcgcttgctgatattccgtaccctagatttcttactttcgaaatacattacccggatcaattccattattttcgcctttcaaaaaatttcccggttgtataaaaaggcaggacttcgacagtcaacaacaattttgagtatatttaccacattttttctgatttttttttaagagggtgaatcaaaaatttattttttacacggaaacgatgccacagttgactgaacct

SEQ ID NO: 15756 - DNA, 482 bp, Saccharomyces cerevisiae
aaggaaatcttttctttatgtcccttctgttcactcatcttctaacaatctatttcgttttgccttcttgtgatcgctttcaataccctgctagctcacatatatacttttcttactgtcatatctacataaaagatttctttttgtataggcgcacttaacgaaatttgattggtctcacgttggcttgtatattctaccttcaatcaatgtggttatatcgcacagaattcccttgtattatgatagaacttatttattgtaattagttttgatttgaccattttcgttggtccgtaattgttttacactgtcactgcttaaatcattgaagagatgctcttgagatagcatccgctctcctatctttccaaagaaacgctttaaagtcgctttaagcaatctctaaagtttaaaaattcctaataaatagctctttagcaactattgtaaaccgcaataatgggcacacccaaacatat

SEQ ID NO: 15757 - DNA, 466 bp, Saccharomyces cerevisiae
gtcattcgctcatgctttcttcaggcagctgtacgtgtactatgtataaattttgaataacattttttttaataaacagtttttactcttttaggttactttccagattgaaaatatacaacgtggttacataaagaaattaaaatgtagaacgaatcatgaccaactgtatcaggtgtttaaaaaggcgaggtgaaagagaaaggcttccccctctaatatcaacagctggagatacatctttctaataattaatctaccatgagccgtacgcactgaagcaacgcccatcaaacatccgaagccacattatgagtacaaaagaggctgacgttaataggaactcatggtgtaattttgcttcacttttctgaattcaaatggaaatagaagtaaaaatgggcagaaaagttacctcatgctttaaatatactcaacttttctctaccgacagtaggagccctaa

SEQ ID NO: 15758 - DNA, 472 bp, Saccharomyces cerevisiae
ataaataaggacatcgcagaagcacgaatatatagataaaattgtatgtaaaagcaaaagttgaactgcgtatgatttcttatagtgagtatgaaattttttttttttttggttatctaacttatttttctttgatacagatcgtgtggttgaacaaccgcgccgaaggcttgatcagtgggctgattaccagacatcttcttggtatctacctgaagtcttgagcatcttgattagctctgttgcttcatcagtggtaatggatttaccacgggataagatgccaaccaatgcggttgacacacccttggccataccctttgcatcaccacagacgtagataaatgcaccgttgttaatcatttcaaatacttggtcttcgtaatcctttaatttatcttgaacataaacttttttggtgtttggcaacctggaatgggccacgaccatttcgaacgaaccatccaatttt

SEQ ID NO: 15759 - DNA, 409 bp, Saccharomyces cerevisiae
aaacacgattaaacttattagtacattaaaaatattcttttattttttatatacatacataagcctttaatacctttaaagcggtaacgactgcctcttgaacttaaaattattcttttttttggatatttgttcgttatgtttaatgtatatatgttgatgttcgatcagttttacgatatgctcttataggaacatttacagttttccccgcattgagtccagaccgaaggttacatacaagatttcttcagcgtttgttacttcaggaaggcaatggtaatcatacgtatcacattgagcaacctactgagggagaaaggagatttgtgcctggaactacttcgtgtagacaaaggaatatacccctttgatacttctcaaccaattggtagtatgcaggtgctgc

SEQ ID NO: 15760 - DNA, 434 bp, Saccharomyces cerevisiae
gaaacaacagttcgcgtctaatatttagttcttactaacattaattctatctcagcagatatatcaatgtaggacgttggaaaattaataaagaattaactctttttattttattttttcctttttatattaaaagtatatttctgtaagtccttgtactaataatatcatttcctaatattttgaaatatagttgttttttgtcaagcaaaactcttgatttcaaagacctcattttgttaagccaaaagcgaaaaattctatttcgacttttctttctgtttccgctccttgtattctaccattgatgctgtcttaaacaataaatatacagtttgaaattaagtttctatatacaggcttaagtttatttaaaaaggaaaccactagatgaaagatgagcctagtccttttttaaagtccgaacgcgacgt

SEQ ID NO: 15761 - DNA, 439 bp, Saccharomyces cerevisiae
aacggttggtgaaacaaaaaaaaaaaaagaacccatcctaaaatactgttattattactaaatagtgctaaataatacatatgccttgattttatttccgaaattttttgttttgtcaatttaggctctattagcttcttcatcaggttcattatcgtctacaacaccgtcttccatggtattttcaatttcttcctcaaaatttgttgtcttatttgttgtagcactgatcagacctctcttcacaacacgtagagccaccgggatagtaatatcatcgtcagatatacccaaatattcccgactccaatttaaaatcctacctcttattctattggcttttattacagactttctgattttttgtaagtttcttatgaattctttattcctctgtagtgcaatctgcgacagctgtcgggcagactcaatttcctca

SEQ ID NO: 15762 - DNA, 448 bp, Saccharomyces cerevisiae
caaaagagtatatttagcttatagtttttagaatgttttgttttcttttttattaaagtagtactactgcgctggagcagtatatatgttgaactatagtcagtcacctataatttgtttgctggcgcgaaggagaaagaaaattttaattaattcatgaaaagccttaagaaaaagtttaagaggaaatgagcaaatagaaggcaaatagagggtgaaagcattatggccgacatcaataaatatattccgatggttgacgctattttgagcgtatccaaccccgatgaaataagcccaaaaagggtgaggaaagccctgcaaattctctattcagttaatttggattcacaaagaaagttaattaatgaattgattcttgagaggttcggcgatatacaagaaaacccaagagtcttaattccgaagaacgacctcattagtcggg

SEQ ID NO: 15763 - DNA, 500 bp, Saccharomyces cerevisiae
gcgagtgtatagtaccttcctaaagcaatataagtacttattcgtttatacgtagacaaacattaatccctcttttttttattgtacccattaaccgagttgggatgtttaatatctctagtataacgtgccgtatatttcctatatatatatatatatatatttatatatattagattttaagttaattgttcaactaattgatcgatttcgcctcttataattctgctatacatatttattttaaaccatctctttgaacaaagtaatatgtcgtcatcatagtgaacttgttcttggacctaattataaattttccaatacggaacaaattatttgttccaacaccctgctagcaacacagggcaatatatataaagaagatatatctactacttcttttccttgagtatatgtctttaatagatatttcatgtatttgattcatctttaatggaaatactcggagattatatacaggtccgagatggccttaaaga

SEQ ID NO: 15764 - DNA, 486 bp, Saccharomyces cerevisiae
gttcaaggcttacgccgagtcgcttactcgctgctcgctttctttcttagtgttgttatcctatataaaacgtaactgtttagttatttaagtccaagtgcatatttacactataatatataatataacatctcatctttttttatttctttttcttcttctcccgccgcgggcttacatacagagatataagaacaagtggtacgtagcatgcagcttctcaaaagagatgagcgttcagttttgagtacagggaagaaaggccaaatcgagagtacattatcatggggtcgggcgatttgaatctgttgaaatcatggaatcccaagcttatgaaaaatagaaaaaaagtatgggagaccgaacaggatctaattaccgaacagcagaagcttaacacgcgattgaaagaaattgaaaaagaacgagaactaaatgaactgctgaacgaatcgagcaaggataagccggagactctcaagaatg

SEQ ID NO: 15765 - DNA, 472 bp, Saccharomyces cerevisiae
aacgcttttgaggtggcagcatagcactgtaatgagatatattaagtaggcttgctgtataccatttcttgctatgcatgtgttttagcaaggcaacgccgttccggaagggaaaaagcgctcttttttatatactgtgaaattttcagattttaacttagaaattatataaaagcggttgtgtatctattgtgataatgcaattcctttatagtttagcaaatcgaaggataggtatatactgagtagtaatggctaggccagttaatacaaacgctgaaacggaatcgagaggcagacccactcagggtggtggttacgcaagtaacaacaatggcagctgtaacaacaacaatggcagcaataataacaataataacaataataataataataataacagcaataacagcaataacaataacgggcctacctccagcgggagaaccaatgggaagcaaagactcacagc

SEQ ID NO: 15766 - DNA, 460 bp, Saccharomyces cerevisiae
gaaactgtatcattcatcaaataggataaaaaataaaaaactgttctgtctcgttaaagtcatatatataaataggggattttcattaatttatatatatagatatacttgtgtacatgtacccgtaagtatcaaaagaaacgtgcataaggacatggcctaaattaatatttccgagatacttccttaagcggtaactttcttttcaatcaagtcgaatagagtaacaatatcggcagagaattttctgataccttcggacaatttttcagtggccatagcgtcttcattcaagtcgaatctgaatttagattcgtcgctgatgtaagaaatcttgtcgccggcttccttcttagcggagacagggtccaaaactcttgggaaaggttcagtactgttcatcaacttgtccaataaagctggagaaattgttagatagtcaacaccagccaagtttttg

SEQ ID NO: 15767 - DNA, 427 bp, Saccharomyces cerevisiae
acaaaaaagagtaaagaagataaaactcctgtatagagatttatattaaatgtatgtatatatatgcatatactgctcttcaaattgcttatgttttataaacattgacatcggggttccacacatcaagataatcattataataccttagattgtaaaatgtttacttactactttaaaataactataaataaaattaaaaatcaaattaaaaatcaaattatactgccattagcactgatttttgttgtttttgttttaaagggatgcacattttttttttttatgttattatcatacactaatttttccctgtttcaattgtttcaagagctgcttgccgtgagaaatttcttgtttttgttgttctaaagttacattactctgatcattaacattgttattgtcaacactcacatcacggacc

SEQ ID NO: 15768 - DNA, 419 bp, Saccharomyces cerevisiae
gaaaagagaaagggaacacttctaatttatctttaaaattatatatatatatatatatatatgtgtgtttgtatactctgtgggtatttccgtgtatatggttaataatagtagtatcttgtcagttttttttatgtttttcttcgcgcgtcaactttctaccaagagaaaaacaatataaggtctccttactctataggagaataaaacaaacaaaaataaaaagcacatcgtagcgccaagaaaatactgcaaataccaaataccacaataatactacaattatctatacacaagtgttttgccgcttaaaacttcgattttcatagtacgaaactatacacccttggtttttctcttttctaaatacatatctaccttgtaaagaatttcccgcacatctttgcgggcatacagtt

SEQ ID NO: 15769 - DNA, 414 bp, Saccharomyces cerevisiae
gaacatttttatttcctttatttttttctttctttctaattccataaccgttgttcaaaattggggagctttttaactttcgttccattaagctttttctttgttctttacgtttgattctatttcaaccataatttattttttcgttatttaataattactaatatttaatactagatgtatatacgttgtgtgtatgcgctactatagtatagcttaactgttttattataccctttttttctctctttactgtacagaagatgcgtcactaattcaaaaaaaaaaaaaaaaaaaaaaatataaaaaagaaagattttggagaagctatatccttttgtgacatacaatagagaaacttgttctgttggtaagatatctcatctgaaatacaacaaggaaaaccaaaagcca

SEQ ID NO: 15770 - DNA, 475 bp, Saccharomyces cerevisiae
tccaaataagcggattatgagtaaataactctaattttgttttaaattctttcaagagtatcgtaatgtcattgatgaattaacatgttagtttctattctacctcataatggatctaaattgcatactaatctcacggtggggtgtaaaccattgcctactatttatatagtgctttatatatgtctcacatagtttaatcaattgtccgtttttttgaaaacaaaagttatttatcattgtaattgtgcttggcaagtcttgtattatgttactgtgtcatttcattgaggtacatctgttaatttcctttaattattttttatcttattaacatacgcctatataaattttttgaaatacgaagaaaagacatctaacaaatataccagaagataaatgctacatatatcttaatcggtagattcagcaaatctttcttgcatagtgctcaacaatttttcgaattcgccat

SEQ ID NO: 15771 - DNA, 439 bp, Saccharomyces cerevisiae
accttatccctcatttatcaacattttattctcatttattattagtattattattatttttaatattatttttatttaaaattatcctaaaattacttctactgttataacatccaatccataagaagcaaaaacaaagttttcatattaagccatcgtaaaggtttaaggcaccaataatagagggatcgactttagaaccttctctgaattcgtccagcgtaatgtaaccatcttcgttcttatccatcaacttgaagatcttctttaccctcatttcgggcgttgcctcatcctcattaagtgtaaccatagaccccatcattttataaacactcgccacaatggttagcatttcatcaaatgtaatatatccatcatggttcaaatcataaagttcgaaagcccagctcagtttttcctccaaagttcctctgga

SEQ ID NO: 15772 - DNA, 436 bp, Saccharomyces cerevisiae
agtttcaggcagaacaagacccttttcaaaaatatgtaagccattattaaaaaaaaggatattttgtataattgtttaataaaataacatctttttaaacaatcataaatagcacttcttatcatacaacctcaaatcatatcggtccaaatttgctcaaattgtacatgagatataactttttcttctaatgctttcatttcagagtttgttttttttttttcttttttttttttttccttaccggagtctgaatctcttacttccttaacttagatgttagtgactaaaatctgatggacagtatcaaaatgtaaatattgtacctaaaaagaaaaaagtattaaagtggtttgccataaattttaaacaagtgaaaagtttcaatatttatatttacatgattgtggacaagcggcattgtctacaggctgtg

SEQ ID NO: 15773 - DNA, 422 bp, Saccharomyces cerevisiae
gcttgttaaatgagtcgttaaatgtacgtatatacatagttactgcgctttcggttatatacaaaataaaacaacatctacaagcaatgcttttttttcaattattgtaacttggatgcttattctaataaaatgaaataaatgctactgtaattttttgccggaggattggctatatatgcagagtgggagttggacgatatcaccattattattatttttctattattaccattggacttgtcttttgcagcaacaaaagtggcagcagcagcaacagcaccaccaccaatgcattttggccttgccttttataagttgtcaaaaaaagttgacctcgaaaaggggaaaaaacatcaatttttcattaaaaaatgcttagcacattcatatgcagtccaagaaatggcagtggctggtat

SEQ ID NO: 15774 - DNA, 452 bp, Saccharomyces cerevisiae
ttgtgatctgtattttcttcgtaccaatatatatcgtttctatagggcaatggtagtaactaatagtaaagggcgaaataagccgatttcagtggcaaataacaactttttcctttgaaaacaagataacattgaagaagataaccaagagaagaaactttcaagatgaaactgaaagttactggagcaggaatcaaccaagtcgttactttgaagcaagatgcaacactaaatgatcttattgagcatatcaatgtagatgttaagacgatgaggtttggatatccgcctcaaaggatcaatttgcaaggggaagacgcttctttgggacaaacccagctggacgagctgggtattaactctggtgaaaagattacaatagagtcctctgatagtaacgaaagcttcagtttgccaccaccacaacccaaaccaaagagggtgctgaagag

SEQ ID NO: 15775 - DNA, 440 bp, Saccharomyces cerevisiae
caaattagttagttggctctgcctatacgcatatatgtatatatatatatatatatatgtatgtatgtgtatatgtatatgtacgtataccttacatcatcatctttctttatattctctctaatgcgcatttacatcggagtacacgtcaaatcttctttgtttggttaagggtaccgcttgtctaaatgactcaatgacttcgggatctaattcagcataaataatctcttctccctcgccagcttcagctacaatcttgcctctagggtccaccactatagagtggccatatgcatggtaagaactctgtagattccttgcgggagaacataacatcacgtacacttggttgtcaactgccctgcttcttgccagtaaatgccaatgcaagggccctgtgacagtgttgaatgcactagggtagatcatggcaaacg

SEQ ID NO: 15776 - DNA, 495 bp, Saccharomyces cerevisiae
ttatgttacccacattctccactcttccacagaaaaaattcctaaagttatagttcacattgttatatatgtatctataaagcgaaattttttaaaattaattgattaattaatattttgtatctaaagtgttcatactatattatttacttagattatacataattaaaaaaaaaaaaaactttttttccttgttttcattttgtttttattattaaatattaaaaaaagtgtccataacatcaatgtttttttttacctttgattagttttcattggcgaaaccataatccccgttccattcccatcataactacgctctcttctgagttgatcttcaagcttgaacatcaactgtccattatgatccttgttaatattttctttgattggactactagaaacacttgaagttccatcttttcttggtcttcctctttttcttggagaccttttaattaccacgttttcatactttttaccaccgctgcaaat

SEQ ID NO: 15777 - DNA, 424 bp, Saccharomyces cerevisiae
gtgtactgttcacatcaagtatttctgtataattatctaaaagaaaataaaaaccctcttttttttaactgcacgtgcatcaaggggatcacagcctccttatcaaagtgaaaaaaaggtagaaaaaaaaactgaaattgtgatataaaagtttaaacaggaaattattgtaaattgaacaatatgtgtgaagcccgtttttggtttgttattcccaactaaccataccctcatagattactctgcatttctactatatggttgaaacatttagttttgctcatttggcttatttggtctttgagtccgttttacaggtagtcattatcgcactcgctggtttttggagcgctagttctggtctgctgcccaaacaaagtcaaaaaatcatttctctgttgaacgtggacctttttacaccatg

SEQ ID NO: 15778 - DNA, 419 bp, Saccharomyces cerevisiae
tgatatccttctctgtagttttgtagatgtcatatatgtacgtttatggaacagcattttagaaaagtattacccagcttatcacttcgttttttttttctttccgtgtactcgctacacgtagaaagaaatcagaaaacaacagctcgacaagtgaaatttgacgttcattaagactcagttaagattgccttgagaataaacaaaagtaatcacagttaactattgaacaagagtgcacctatgacttcactttcttcacagccagcgtacacgttggttttcgatccttctccgagtatggagacttactcgagtaccgattttcagaaagctcttgaaaagggatctgatgaacaaaaaattgacacgatgaaatcaattttagttacaatgctggaaggaaatccaatgcctga

SEQ ID NO: 15779 - DNA, 456 bp, Saccharomyces cerevisiae
cacggttgaacaaagaaagattacattaatcaattatagtaatagtaaattttttattattttatattttaaatttttttactttctcagtatttatattacataaatatgtatatatcaaaaagtttctgtcgtagaagagacccgatccgaggttattgaatgtaagtgcgggaaagtgcagatagaatgacaatgaatgctccggaaaaaaaaaaaaaagtacgtgacttacttgcccaagtaagtaaagatgccaagtgtcttttatgctaatagtgtgctaattctcgtgtacaacacttacaacagagacaaagagttttttctggagtgtgagcggcttgaagcagaggcatccaaaagagcggcattggcaatagccagattcaggtcatcgacgtttgcgtcagagttctttcttgagcttggctgagagactggcgaaagagatgg

SEQ ID NO: 15780 - DNA, 441 bp, Saccharomyces cerevisiae
ttaaacgtgtggtttatgggtgcaccagggctttatcgtgttttatatcgatggcgatttgtgcctccagtgtatttttgtatatccaattaaggtttcttacctaattttatttttatcatctttagttaatgctggtttgctctgtttctgctgctttctgtgcggttctcctcttctcttgtttcttcgtgttgtcccccatcgccgatgggcttatatggcgtatatatatagagcgagtttttacgtcgaagatcatctcagtttgcttgatagcctttctactttattactttcgtttttaacctcattatactttagttttctttgatcggtttttttctctgtatacttaaaagttcaaatcaaagaaacatacaaaactacgtttatatcaattaataatgtctgaaattcaaaacaaagctgaaactgccg

SEQ ID NO: 15781 - DNA, 404 bp, Saccharomyces cerevisiae
ttttgcgttagaataactacgtacccctatataatatatttttatatcattatttagacaaggacatgatagcgttgactaagtcaccattgtgagctttcagggctttgatggcttggtttttggaaacgttagtttgttgaacgactaactcgatatcatccttattcaagtcaccggcatcaacttcaccttcttcgtcatcttcttctgctgcggcgttgacactgccttctgcggcggcttgcatgtcagcttggatgtcttctggggacttggtagcgacgtcttcgttagatggcataataccgctagcttgagcttgttgttgagcagcggctagcttttgggtaaagttgtcaaccttagcttcaccgaagacaacgtagttaccaccggcagat

SEQ ID NO: 15782 - DNA, 418 bp, Saccharomyces cerevisiae
gatggttacgtatcctgtgcagccttggacaaattttataattgtatatatctatgtatatgtatacgaatggaaaaatttatccgaatctcggcccgactgccagcttgccgggagaacaaacaaccgccaatatatgtatatgtatatttatatagatgtccagatgcattattgtgaatgtgagttatgcgaagatacttgtttgtatagctcgttcaactcattgatggagaatggaatgtcaatatcgtttagtgctgtgttcgtagttgtatatgcgcttcctgtttcattgatactaacaggttccatagatatactagggctttgctcaagcggatcgagggaagccaaatcaagattgtcaatgctgtcggccttaatttctccgttttgcagaggtggcttcaaactc

SEQ ID NO: 15783 - DNA, 464 bp, Saccharomyces cerevisiae
ttcgatcaaaagcgaagtatttttttttcctagtttttatgtaaaaatatattcatttttttctctacgcagttgctgcagtgttataagaaaaatagaatgaaataagataaagctagacgaattgtgtctattttcctacatcgccatagaattgctttttttttcttgattagatgaaatgaaaacaaggaactctatttgttttcattttgttgggcttatcatgtaaagaaaaatgagtcgtgtcctctttttcctcgtgcttgtatgactgccgcactttccgctaagtgcgctcgtctatatgattttatgcaaatatatactgaaagttcaacaaaattaaactatgtgaacattagttcatagcagccattggcccgttgtgtcgggatctctacactaaattgtaatgtctctgggattttgtggggtgtcattgcagatatgacgaaccggat

SEQ ID NO: 15784 - DNA, 416 bp, Saccharomyces cerevisiae
ggggtgcagtgagtgtatataatatattagagaaagaaatggaaagagatcgggccaaagacacaatatgtaacagtatggtttcttggtatcccctctttctattcctcccttgttacgaaatgatgtatatttgtatctctataacaaaattatatgaactgtctcaaagcacatgaagaaggaaaaaaggtggcgtcgaagactgctagatatttctcttcgtatcttcccatccccttctgcaaataacggtttttccattgtctatttcaaagttacccgcataataaagtcgtacattgttcgaaaaatatcactcaaaagcagcattgatccggtataaaacaatagaaatttttttttttttttattgttataattattctgactcacgtctggatttcgttagttcg

SEQ ID NO: 15785 - DNA, 471 bp, Saccharomyces cerevisiae
gtatatacattatcgttacgctgacatttacaagtttaatttttttttgactttttttaaatgactttctcttcttttaagtgtactgtcttttcattatacacacatatatatatatatatacgtaaaaaagcagactaactgacaattaaatcgttcaacattcttgttgtttgcaggtttgataattttgacctgaatgcagttttcatcctttcatttcccagcaagaactttgctaatgcaattctcaagtactctgagattaattcgcttatatgattgatggaactatcttggttgccaaatttgtacatgatgaaccatgtcaaaagtagtagtgttaagggtatccagaaaaatattaacattttatcatttcggaagttttgtttgttttggaagaatctgttaaactgttttttcaaaaattcttcctcttcctcataatcctcttcctccgaattttca

SEQ ID NO: 15786 - DNA, 407 bp, Saccharomyces cerevisiae
gagtgtctcgatctctcagtcgttaacttagtggcagatactgccctttttcaatcccattccttttctcattgtatgtacgtatgcctttttttgttattttagctctaactatagctacttgtttttctcccagtatgtgtataatcttattcttctctacatataagtgtattgctcagtaagtattatcatctattaaagaagaataaaaattatcatgtatttatttacaagtgcgtatcctatatatatatatatatatactttcgcgataaaattttttaccaaatacccttcttaacacctggcaaattacccttcagagcgttttctctaaattgatacctacacaacctaaaatcacttagaacaaatcttgcatgtccagagtccacgcacctatt

SEQ ID NO: 15787 - DNA, 483 bp, Saccharomyces cerevisiae
tattgtagccttttctatgtatttgtaaaaagaaacctagcgcttataaatatatacatacatatatatataattgcttgttacgcaacttatacatatttctgtcattaaactagtttttaaggtgaatattcataatttatgtcagtattaacattgaaaccgtcaaaaaaaaaagtatcaatatagacaaaggaaggaccattttaagaaagtggttttaaggaagaaacttgttcctgcatatttatagttaattcctatcttcttgtttatcctgttttttgaccacctggcttgcagctaatagtgaaaaaacacaaatttttaccaaccttccatggtatagtcatgttgtatactcggtgtaacactagtaataaactttaagaaaacaatcaagtattggtctacccgtaacgaatcatcaatatcgtcttgtaaatcctcccagtctccgacaccgtccagctcttgttcttc

SEQ ID NO: 15788 - DNA, 500 bp, Saccharomyces cerevisiae
aaaagttatcgttccttcttcttttatgtcactaagagaaattgttacctatatggtttgttttgtctttttttcatttttttttaagaatcagatccatatatgattatataaaattataattaagtagaagcaaaaaaattttcagacccaaaaaaaaaaaaaaaaagaagaatgcaaaaatggggtggtaacataatcaaaaaaggtcaggacatccttagtttgttacaagcgtgtggtgttagtgcgccggatcatttcctctacaccaacatcacaaagttttctgggaataataaaaatagatcgagaagatggtaagaaatgatgaaatatattattgaacttggttgtctgatttgttcaagtaggtggctattgcagcgcctagaagattactgtgatttaagaattgcaacttaatatgtatgctggagtaatattttatctgctctcgataaaaatttgaattgtggagaaaggatccaacgtagcca

SEQ ID NO: 15789 - DNA, 472 bp, Saccharomyces cerevisiae
tgctctatgtaatcacctacttccctactcaacaaacttatcatcttttttttctcccttcccttttttttttgtcttaaatactagttattatcctttgtaacctaaatactcgctcttattgacaaaatgcaaacgttttttgtttttaactgtcaagagaagtatcattttactattattagacttcattactgagtttattagttgcgtttttttgaggtctcattattaacggcagaatgttagttttcgcggaaaataaacaaaatagcacggaaaaaagaccaacaggttccaggaaaatactaatttacaaaaaattgacaaatcaagtgagggtaccttgctattcatcaccgcattcaactaactggaggtacaaagctgataaaatttcacagagcaaagtctcacttagcttttactttatgaaatttgacctttaataaccgaaggtcatcgtaatacg

SEQ ID NO: 15790 - DNA, 446 bp, Saccharomyces cerevisiae
cgtagattataattaaggcgacttttcaaataaaaaaatactgatcgttgtttttttttaaataaatgtttatccattcaatggactataataaatatttatatatatatatatatgaaaagattgcgaacaaaaaagatgatggaaaaggagaatctctatatatatattcatcgattggggcctataatgcatcaagcatctaaaacacaaccgttggaagcgttggaaaccaacttagcatacttggatagagtacctcttgtgtaacgaggtggaggtgcaacccaactttgtttacgttgagccatttccttatcagagactaataggtcaatcttgttattatcagcatcaatgataatctcatcgccgtctctgaccaacccgataggaccaccttcagcggcttcgggaacaatgtggccgattaagaacccgtgaga

SEQ ID NO: 15791 - DNA, 414 bp, Saccharomyces cerevisiae
accctctaagtagaaggcaatttaataatttaaaagtgccaaattaatatcaatttacatagtatggcaaacaattttgttttcctttcaattattgtagtcaaatattatttacattctgctattttcattgtaccgggtgaaatattacatgtaccgcccatctcactaaaaaaatgaaaaaaaaaaatctgctaaagacgcaaggctctcacaaatagcttaatgtaagaagggcaggtggaacagcaaattcaaatcatttaacgcatccatacattcaaaatgaactatttagaaggcgttgggtcaaagaaaggaggtggtggtatagcctcagaatctcagtttaacttacaacgaaggaaagaagtcgaatcattacttagtaaaggcgaaaatgtcccgtacact

SEQ ID NO: 15792 - DNA, 407 bp, Saccharomyces cerevisiae
tagttcgggaatcgaggcccgtatttcgaggcttttgcttttccttttttttttttcgtttctccacgtctatactacgcaatgactgaatatatataatgcgtcgtaaatagcagttaatgtataaatagaaattgagtaaactttaattttgcctaagaaagaacctattggcgataattaaatctcgtcatatatgcactatatattttttttcgtttggcgttgtttatctatttcccgaacgggattatttccctgaattagttcataatgaaaaaaactcgcagccgggtaaccctcttcgtaccaaaaatgcacgtgtctgtacacaattataccaacatggttgtagcatttcaagttagcttgttcgagctgtatagtaaaagaaacgtcgatgtggc

SEQ ID NO: 15793 - DNA, 480 bp, Saccharomyces cerevisiae
tagctttcttgaaataaaactgaaagttttttatttgaaatatgtacaagtttatacatttgtttaaattaacctaaggaatgctagataaaatgaacagaaaaggtaaaaaggcaaaaaaaaatgtttcgcatcggaagttcatagaagtctgaatgggtacactatgactatgtattgatatagcggtttaaaacgaagattttttttcttcaactttactctaaagcaataaatagaactgtgcaaacaaaataaattggttagttagtgtcccattggaacatgtatggctccttttctaaaaccctctcttttcttttacatcattaaaattaattggctgttgctgcagcatctttttcaccttgggccaatatgttattagcatcactttgtaaatcaaatgtcttttccatttcgattagctgttgttcggcaagtatagataaggatagtggcacaccgagtaacaaagca

SEQ ID NO: 15794 - DNA, 424 bp, Saccharomyces cerevisiae
atgctcgtgtagtgaacctaaatagggtatatctttaaggagagtttaagaaacaatttaataataactgtttgcaaaatatctttcccaattttttttgtttataaagttatatatatacatttatacaactccttcggaggctgatagactagacccttccaatcatatctggacaagtaacagaaccctaatgttacaatatataaaaaatgccactaataaaaagaaaacatgactaaatcacaatacctagtgagtgacttaggcttgagtagaggaggagtatttggtaacagccctagtaccttcggagacggcatgtttagccaattcaccaggtaagatcaatctaacggctgtttggatttctctagcagaaatagtggatttcttgttataagcggccaatttagaagcttca

SEQ ID NO: 15795 - DNA, 409 bp, Saccharomyces cerevisiae
tcgaaataatataaacaaacgtgcgtatgcaagacatgtatatatgattagtagttttttttatttactttcattgatcaattacgtgaccagctatacatttcttcattacttcttctgggcattctatttaaatcgatatttccaaacgactttgtcattgctgcataacccttttgataactatcgtttaaccccacacctctgtaagatttcgattccactccattatgtatatttcttccagagttaaaatgctgcttgtaatctgaattttttctctggaatagaagttcattttgattttcaaatgacataaaaggttttgtttgatgtatattgttagggtggaaaaaatagggtgttccaccagttatggagttttgtagttctgctttttctccccaaa

SEQ ID NO: 15796 - DNA, 493 bp, Saccharomyces cerevisiae
taaatcccctgtttcctttcgttaacatctccccctgatctgggggatgtggggtggaatgagtggcccggtcaatgtcagtgcaccactctgaaaagcttgcacacatacatatacatatatatatatatatatgtaggtatagtaaaggtttgcctgagtaatttttgcgcgagagatctactatcagcagcgatgagagcagctacataacacatagtaaatcacacatctacgcaacacacacacacacgcatacactcaccctcatgacagatccccacttgaacacgccccaagtgagcacgtcacccacatttgaaagatcacaggacttcctcaacatcgacgaaccgccctgtgcacaggaaacacctagtgtttctacattcaacctcccgggtccaagcgctcccgctcaaagcgtagacaagccagtccccatgattagacggcggtctaccaattatatggacgcactaaattccaggga

SEQ ID NO: 15797 - DNA, 418 bp, Saccharomyces cerevisiae
gcaggtcttcttcttttgaagttaggtaaagcttagttttcttttatatttcctgataatacatactcgctagtcaaacctgtcaattattatgtgtcgcaacagactatatacgtatacatacatatgtattgaagtgtgtgaacgaattacgcggctgctagtgccgtacgaacgcaacaaaacggtttagaaattgctacctaaagcacgcgccttttccttagaagcagcatacgactcctctgaggttatggtctttaaccatttggaaatggcaggataatcctctggtgcggcaaactttctttcaaacgccatctgcaaagggaaagacatcaagatatcggcaccgctcaacttcccatcaaccaggtagccgttatttttggaaatttcaccctccacaaagtcgaac

SEQ ID NO: 15798 - DNA, 439 bp, Saccharomyces cerevisiae
gtaagtattttgtatgtgttgtgtgatctcatgaatattctatatagtaagaaaagaatacaactgtacatacgcatcctactagatacctaatgtacagacatcggaaggagcgctaggaagcttttattattgaaggttttcagcgatattctgagaatgttttttcggctctggtgatcagttctcacatgcatcatcctttaataaacccatgcattaagattcgccttatcagcaagatcagataagcgaacagcttcatcaatgaaatagaatgcttaaatcttgtgaagcactgtcataagccagtttgataaaagcaatacccacaatatagttggatatcatttaccttgatctgctcttgctttcgaggtgacatagcatttttagccatctgattccttaggttcaaaggcactcatcattcctcctc

SEQ ID NO: 15799 - DNA, 432 bp, Saccharomyces cerevisiae
atacgaatgtgggcgtatataataacaaaaagtttggtctatttattatccactccgtatatgtatatacatatatacaaatttcgtttattaatgttagaggcttataaaaaaaagcttgacttttccttatgtttcaaagagaggatttttgttgttattttcataatagcatatccattcttgaaaagacttcaaatacaccagcaataacttccaattgtaaatcatgaccaggattgttttctatctcttctttaacttccttgtttaaattaacggagacacctaactcagtttccttttctaaatcaaatgggtattgcgaaaattgtgccattatttcttcagctctactaattgccttatctctcttctcatattccaacgtagtcaggacattctccaatacgtttgccccatatgatccac

SEQ ID NO: 15800 - DNA, 403 bp, Saccharomyces cerevisiae
cctaaatattagttgacctatacatgtataacgtgtatatgtaactttatttttttttatccctttccctcctttcattatttcttcttgtctgtcacttatgctctataacaggaatgttttcgacacacttgagcaatttattcaggctgcatcctgcaattctttcaaggccgaagccaaatccttaatcaaatcattagcggattcacagcccacagatactcttattaaagtttggtcgatatatgggtcagtcattgctctccattccacaagggattcaattccacccagtgaggtcgcatgatggaaatatttcagcttgaggggtaattgtttacactgctctttggtgtacaaagtgatagcaaaaacgggaccatatcctcctaccagttgc

SEQ ID NO: 15801 - DNA, 416 bp, Saccharomyces cerevisiae
tagagcgtataaagatttttgtcattagtaatcctcaaatgttgtcaagttatgtaatattgtatatgaaatggaactcgactaattcaaaagaaaggtcatcgaggggttaggctccccattttatcgaacaactctttccttttaagcgctaattatatgattctttattatacagaaaaaaatacattgtgagagataacgcaagctgtaagtgaaatgtacacgggaattcatcatcagtccttcccactaagtaaacaaggtgtcttcatctctcaaatactcaccaatatctgcttgtctgaaagcaactataccagtgggttgcatgtttcttgactcagaagtacttttcgcactgacaccgaaccctaatggcacatcattcattgcaaacacaataacaccggcgt

SEQ ID NO: 15802 - DNA, 457 bp, Saccharomyces cerevisiae
tctagtttttttttttttctctcttctttctagctagtagttcatttccttttctttttttcaaagaggtcatatttatcaccaactatatatttttttgaagaaaagatatcattacaacgataagtagttacaatattttttttatttagtttaaaataatgagtaaatgacgtcgcatttcttcgcttttgttatttttattctcctctcatttttgaggagaatgttacaatattttactaatgtcctgaataatatttgatttatggcataataaagaaatgcgaattcgttaatttgtcaaacttcgaagagcatcaactgccttcctgaatcccattcttgcagccctctgataatattgtttggccagatccaaatcaacttcacaaccgacacctttttcgtaataaaatcctaaggcaaattcagtgcgggctaatttaccgtctga

SEQ ID NO: 15803 - DNA, 491 bp, Saccharomyces cerevisiae
tcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatattctgtatacctaatattatagcctttatcaacaatggaatcccaacaattatctcaacacccacacatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctg

SEQ ID NO: 15804 - DNA, 470 bp, Saccharomyces cerevisiae
ggcatcctgcaactgttctgtggagctattaaatctttatagtaaatttttttttacttttttttttttttttttttttttttattatttacaagcgtctatatattttctattatagaatattgtcatttattacattggttcatctgtaaatctcatcaaacggtctcgtatcggcgaagcaactgtcccaaacttcatctacaatttttgctgcatgttctttgctttggcagttggggttccccgaaacactaattattgccctccttctaacacaatcttggtgtccccttgccacatggaatcctgtcctaaaccctcttctcttgaactcttcccaaaacctgcattccccacttaacgaagaggctctgatttcagaacatgcatgatgcttcagatttaaccaatctatttgccattttagatcatcgaaataatgaattaattcatgcgaaagcgtatcc

SEQ ID NO: 15805 - DNA, 424 bp, Saccharomyces cerevisiae
caactttcccttctgtttcaatctttttacctattcctttttaaaagatatatatacattaaactccttctacaagtatatattttatacatatctacagggcgtatatatacataacattttaagataagcaagtgaatgttgattcccgtttcttagtcaacacttctttctattttacccggtcgttaccctattaaaaaaacaacttacaatcattgttcgccccttccatacttactgccactcgcaaaagggcccaaccagggcaattacgtatcaaaaaatcatgacaggctgggtaataaatattcgtgaagaaagaagaaattaaaaaaagaaacgaagaagcaaaaaaaagaaaagactccgtttaatcactttcaaccgcggtttatccggccccacccatgcataaccctaa

SEQ ID NO: 15806 - DNA, 496 bp, Saccharomyces cerevisiae
ccctcaggtgtcgttaaataagctacatctaagaaaagtttatatagtacttcacgcaattcctactagtatttttttccagtacaggacgatatcttgaagcagcaacttgatttcacaggtcacttagtgtgggcttctgactcaagaatagcaagtattacatgcatgcggccctctcctttaacagcgcgatatacgtgaagaaaaatttcaatgaagagtaatgcgcttattatcaacttcgattgaaggggtcctatatcagtatgctacaagggaaggttgttcgataaacataagcttctcattagcatgagttctatagataatgacagcgatgtggatttaacagaagatttagccgtggccaagatcgttaaagagaatcctgtagctagaaaaatggttaggtatattttatcgagaggagaatctcaaaattcgatcataacaagaaacaagttacaatctgttatacatgaagctgctcgcg

SEQ ID NO: 15807 - DNA, 494 bp, Saccharomyces cerevisiae
gttattaacgtaacataatccagtttattttttgcaatagaaggcgtcatacatatttatatatcaatgtatacattccattccagttacttcttttgcatcttgcttcctgtttaccttgacctcgaacctattatttgtccgcaatgcgcctttgggtgaaaagggatttcgtttccattttaactgtacataatgtaaatgtagaaaagcgtggttcttaaaggatttacggttcaatacgcttttataaacctgctggtgctctaattacgaatgaaacatggaccaggcaagaaatttctacaacacaattttaaaatcgtcgcacccgttgctactatcatttcatctggcaggtaaggcagttcccattgtattttatatcataggatcaatgtttttgaatttcacacctcaattcatcactgtcgttcttttactttcttttgacttttacttaacaaaaaacattacaggtcggaaactggtcc

SEQ ID NO: 15808 - DNA, 463 bp, Saccharomyces cerevisiae
gagctttaaacaaggaggagtataaacttttaatttttttttttcacgttttgccttttatataccgattaaatatttatatttctgactttttctttaccgacaccaacaggtgtaggctcaaaacataaaaaaaaagagtattctataaacagttcttacgaatagaacaactcttaaaatccttttcttgccaagtcatcggttatcttcaagtaaaaattcaggatgtcaaccttctctccgacagtagtggtacgaaaaaatttactccaatcatcctgtaacttatttttccaattgatgacgtccagatgatccatgtccttcaaagtccccctgtattcaccccatttactactatttatggttacaaggccatcgttggggcaacctttagacctttcataaacaattttccagggagtacaaaagacattgtaccacttaggcacaaaggagc

SEQ ID NO: 15809 - DNA, 446 bp, Saccharomyces cerevisiae
tatgatggttgagtaaaaagaaaacaaggagataacttatacaaatatatagtaacccgtttaagtccagtcttttttcgtaactatttgcccatagtttatttcgtattcatcttcactatttcctcgacaaaaaagatgcgcacctaaactacatggacacctatgcaatgctatatagaatatgaatcgccaatgctttttattatatcatcgtgcaaacttttagtctgctccttttcaaggcccatgatttcttgcaccaatttttcaagagactctagtccaagctcagcctgagttcttctacctatcctgtatgatatcacttccccgtcggtatcggatttctcctccaatctgactatatattcgcgcttttctaaactttttatcaaatcttcaatagtaatgttcagtatagcaatctttgaaccatcgcttgg

SEQ ID NO: 15810 - DNA, 491 bp, Saccharomyces cerevisiae
acggtgtgatgttcattagtactttttctagagttagatcacataataatatatagttaaacttttatttaattgtaagttatatgttataaaattaccaaatgctgaatgaagttctgcgttttctgcgatgctggatattgacttaaaaaaatataggaatatcctttgttggatacttgcagtgattctcttcatcctcactttccctgtttttattgttttcttcttcagatggtagtttaatttttttcccattcaattgcagcaagttgtcatttgaagtttcattgcctttatctgtaccatatctttttcttatagttgattttttaaaactattacgattgccaagttcattagtctccatcaggagttctatttctgtctgtgctgcctcatctatggattctttttctagcatgcaaacctcaattactataccgggataatccttgggtagctgcagttggcgaatactacctggtcga

SEQ ID NO: 15811 - DNA, 460 bp, Saccharomyces cerevisiae
aaaaattaaaagttttccgattgaaaacttcatttagctttacccttctctgagaagaaaagattgaaatgcgtatatctatattttagttttagttacgattatgctggtattatttagttaagtacttaattcaattgtgaaaagacgaagacaatatttttagtatatcctccgtactttcattttcaatatggatttgtgacgatcgatcttctcttgctccttctttattaatgttgtcgctacttcttcgatagggcatatcattctcatacagtccacccatttgtaagccatacgtcttgttggtcggaaacccagaaaaagagcgggagtgttcgagagaggcaaaatttttatctcctctgtctgagatcgaattcagtatgaatgattccagtcttgttattcttgatgttagattatcaatgacagtgccttggtcatatacgattcg

SEQ ID NO: 15812 - DNA, 437 bp, Saccharomyces cerevisiae
gcgctcaaaccaggcttttcttttccgtttttacgagctagataagcgcatccatatttactaatagatataatgagatatctgagatacatgtgtatgtatatatgcacgttttcttttattatctaaaaatcatattatattaagtaagagaaaaaaatgtacaactatataaatatatatttatttaaaatggttttgaatttttcctattctggttgatattgcccaaaagctattcagtttactcctcttcacgatagtcagggttcttctttaaaattactacgccctcaatatggcttgtgtaactaatatattcatcagtttctagttctgctctttcgccatgatttagtaaaacaggagtggattgcgtaatccagccagtaatcttttttggtctgcctgcttggccgacagtttccactgcttga

SEQ ID NO: 15813 - DNA, 403 bp, Saccharomyces cerevisiae
cccaaggtttaaagtccttttctttttttgccgtaatgtttacttaccctcgaaaaaatgttatgtaatgactgcggtgctacaggagaggtaaatgattttctatatacgtttatatttcttccatttacgcacactattttttgtccttgaataatttaactcaaaaaaagtgtaaaaaactgtgtcattaggtatatgttcaatacttttgatcttcaaatgacgtaaaaaaaagttttcagacggacttaaaccgccaaccagccttggccacaggtgtatgatgcgaagattcgtaagcgctcacgttagtcacatctcaggattggaaattatactagataataaatggctttatttaatcatattatagttgatataacaaatcacacctccgctt

SEQ ID NO: 15814 - DNA, 407 bp, Saccharomyces cerevisiae
cccatttaatatatctctgcgtacatatgtatatatatatatgtgtgtatatacatgtatgtctgtatagaaaacgcatatcaactgatatatatacacgtgaagcaaaaaaggcattgcctctgtcagagaaacgaactatcctcgttgctatagtgtcttctgcacttatcgcgtagactttctattggcactctgtcatggcatttaatcttgtacacattctttaattcttcttgcaaaagaaggtactcttcatgcaaatgatgactttggagtgaattgactaatcctgagtcgttccagaaactttttaaggcgttcgtttcatgatttattatgtcatccaaccgtctcatattaggtttcgaatttgttacaaattctcgccttgataacctctccag

SEQ ID NO: 15815 - DNA, 483 bp, Saccharomyces cerevisiae
ttccgtggataaacctagctaaactaagtaaatctgtatactttttatacatgtaagactttttagctatttcattcttccctgaaccgttttgcgcgattctacggaatataccggcgaaataaaagagataaacttatggatcctcaaatagaggatgaacagatgtgaagaagaaacgagcttaattatatcttcgccatgataactaaatacttcagtaaggtaattgtcaggtttaatccctttggcaaggaaggtatgtattttttttcgctctgttattcgttctccttacctttggccatcatgatttaaagatttggctaaactaggctgaggtaggctcgaaccgatctatcacaaatactaacagcaaatgatatggtcatatcattgatttcagcgaaagttgctaggttagtacttgctgccattccaccaacgcaacgaaacatgggcacgcagattcaatcggaaatt

SEQ ID NO: 15816 - DNA, 489 bp, Saccharomyces cerevisiae
aaggaatttcaaaaatagtcatctcaaaacgtttattctaaagtttagttaaatttatatctacacaactttatgcaattaatcttttatatctacgttgccatcctttaatctacacatccaaagataacaagaggcgcacatgccttttgactcaagtgtcacgtgcatcagtttttcttcgctaccttgtttttctttcctgtcttactgatggtaccgttcttactcttctttttcttcttcttgatcaaattctgcatgccccccttaaatacagatgaatactcttgccaaaattgatctaactcacttgcttttaccactgttgagcattttgttttcttgtcatgcgagccataagacattctgattaatagtgggtattctctgtcagatcttgagctaactgaaatttcagaagcctttttagatacatcatagtcaggatggttggtagaatcaaattcaagattcccttccacagga

SEQ ID NO: 15817 - DNA, 442 bp, Saccharomyces cerevisiae
tattcagcttctttattctaaatgcgtataaatttgtattcaccttaaacattttcgatcatttaggaaagggcttgcaacgcgttgaagtacccttttcacgaaaaaaatggttgtatacgtaaataaagaacaatgtatggattatggtatagaataatagtagtcacatattgcagctagttaaatgagccagatcgttgattttgttgaggacaaagattcaagaaacgatgccagtattcagatcatcgatggaccctcaaatgttgaaattatcgctctctcggaatcaatggatcaagatgagtgcaaaagggcacatgtaagctctgcagagatgattccatcatcaccgcaaagaaaatctgtttcgaatgatgttgagaatgttgacctaaacaaatctatcgaactttctgcgccgttcttccaagatatc

SEQ ID NO: 15818 - DNA, 485 bp, Saccharomyces cerevisiae
tgtattcgtttcacttggctcattgtatatgttacttagtgtatgtgtataatatcatagtttagcattaactaagaggcaaaattataccgctggatatacaggatataacaaccgtttgtcttttcgagaacagaggggcagagcattgctgctttttccccgtcctgaccttattaatagtaagccggggggcccgttcctttagtgtattttgaaaaatagtaggtacctgctttgcaaaaaggactgaaaaaaaaaagataataagtttttgattagaggtaaacacagcaaacgaccactcagcctagcagccttgaccctcgaatttaaaaaggcgtctgtgttgatagtaactagaagataacgtttactacggcgacttcatatttttaggctgtttttactgttcctgaaagaaagaatttattacaaagaacaatagatcaattgtaggcactatgactgaccaaagaggtcca

SEQ ID NO: 15819 - DNA, 435 bp, Saccharomyces cerevisiae
acgtgaacatgtgtgcgtatatacatatatatatatatatatatatatatatatatatatatactttagcatcgaaacagctagtcctttttagagttcaatttttccacaaaggcttttttagccaattcaattaggatatccaattctccactatgctcacacatgctataaaaggcactttgtttgttaagtaacaaagaatatgggtgatcatactcttttacctcacctgcatccatcaccaaaattttatcataatcgataacagatctcaacctatgtgcaattgtcaaaattgtactaccttggaactcttttcttatggtttcttggatcttcgcatcggaactgtagtcgatggacgctgtagcttcgtccagcaatatgatctttggactcctcagtaaagatctagcaaggcacatcaattgg

SEQ ID NO: 15820 - DNA, 493 bp, Saccharomyces cerevisiae
tgttaagttagattttcatgggcccactgatatatagaaggctaaataacgagaatcatatatactgtaacatgacacctgctgatttttactgatcgtagccattcggctcatattacttcatgtcccttttttaaatccctcgttcccggagagtggcatagcatgtccgatagcgtacgccaacctacagaatcaggggatcagatttcctgaaagcaacttatccatcagtttctttttataatgccataatgacaggtgtgcctttcttattttacttcgcttgctttctttctattgcatgcttcaatctttgaatatttgctaatagtgaaaaaaaaaaaggaaataactatctggtttatctgcattgttcttcgtttttcaattcaagaatttaagcaaaaggatatatcatagaacctagtgaatttttaagaaagtaagataaagaaaaaaatcaaatgctgttcagctggccttatccaga

SEQ ID NO: 15821 - DNA, 450 bp, Saccharomyces cerevisiae
attatggatatataacgtcattttgagatattttaaataaagctatcttcacataacctttgtattcatttttagttaactcatttacatcatccacttactacatttgtattttttttacgatttgcgtaccgcctcattactaccctttttttgcactgcagtaatagtacactcaaatcatgatgaaaagagaaaagaaaaaaatgccacaaaaagtagttgattttataaaagttatcatccaattttaggtaattttattctctttatgtaacgaacatatgaagatttcttctctagaatggcattctaactaagtccgtgccataaaatcatcactaacaaatataagatcacgctatactatcaatgaagaaacaaatattaatagttgctgcacaaagtattttatgttctactgtttttggcgagcgaagtaatgtaggc

SEQ ID NO: 15822 - DNA, 420 bp, Saccharomyces cerevisiae
tagaggaggcccctgcatccctctgtattcattaccttctattgtgagatgttaccattacctttttcttttattgtaatgtttcttaatttaaatactatatagggtaattcatccttccaccaacaaagtatcgtttgagtctatctattacgggcatgcggcgagcatattaccctactgacaatatcccaaaagggaaggagcgcgttcccaatagggctgccaccttcccaatatggtacaaagcctaccatatggggaaatcagttttctcgctcacctcgcctagtcttcctaaaacgacgttcctcagtctcctttctcttttataaaacaccatctctgtcttgtcgatgacacagcccagttgggaaaccggtgctgacaaacaggaaaaaagcaagactagtggcctgg

SEQ ID NO: 15823 - DNA, 408 bp, Saccharomyces cerevisiae
ttttaaatggaatttttaatgttcgtatataccaatttatctattgaatagttttttttaaattttactgtttcttttaaacctcgaattattgtgagaactgatttcatcaactggaggctgtagtgtacgttttgaaaacggaaatgatttaccgttttcttttatgatgatgctaggataggcaccttcaaacatgcatgtcttcctgcccacattctgaaaatatttaacgatggatgaaagaaatcaacaatagaaaaggccagttgtcagtttttatataatacagagaagtacatatgacagtttaaaagttaagcattaactggtaagttgaaataataatataatcataagcggaacgaacattttcgacacgtactaaaatcatagtagcatggcggc

SEQ ID NO: 15824 - DNA, 494 bp, Saccharomyces cerevisiae
tatgttatatagtctttttatttatgtatcctaaaatctcgtcaaagcgcacttttatatgcttaaacctggcaatgtggaactcttgatgtttgaatcgatgcctgggatttcttgacgcggtttcttgttgatgaatccattcatgtttggtaacgcatgtggttcaagtgtagctggtggtggcggggccgcaccgaattcactcttctctctcacagcattgatgtcgttattgatgccaaaaaaccatccatttatcttcttattgttataagttggatcatcatatgcattaggatcaattggcctcgctctagtccaaaatcttatggttctatccttagctgctgtggcaaatatatgtcctactggattatatgataacgaggtgatacacttatcatgggcgtatggaatagtcaaaataggttcgtttagattttgtaaaagatcaaaatgctttagcgagccgtcatagcacgccagagtga

SEQ ID NO: 15825 - DNA, 485 bp, Saccharomyces cerevisiae
tcacgtaaatgatacgtaagaagtaatattatcatgatgaatgaatgaatgaatagaaaactacatggtacttatacatataaattaatatatatatatacaaattaaagaaaagtacaaaacaatgtatcattcatgatcataatcattatcattatcagcatcttcattataattacgagtattatcattgtcattatcattattatcgttattatcgttgttattactattattactattatggttggtattgttaatgttactattactgttcttgtcctccggcggccccagtatgaaaaccccattttccgtgttcttattatcaacgtcttcttgagccctattgattaacatttcccttaacttgttgtgtaaatcagattctgtagataaggacaactgttcttctagagactcaacattgattaattggccgccaccacttgttccattactactcccggtatctgaatcaagga

SEQ ID NO: 15826 - DNA, 435 bp, Saccharomyces cerevisiae
agcggaaactaagtagttcatataaatgcattttttcataaatgtgataaagggaaaatttctttttccacttgaaagatatgtacgtatttaagaactgatcttcttgaccactttttttatgcgtgcaactttaaatgctttcatacatttccttggtctttcatcagatgatatgccagatatcaacaattatagacctaatataacattgagttattttttacacgtataataataactccttctccggcaatgaatattttgcttccaaattgcaaaattcaagatttaattataaaaactctgaagtaatagaccacctatttcaaaaatattccgtatttttccctctctataaaaacaaagggcttccaaaatatccattccaataaacggtaaactcacccatttatgattgggacaagagcaaaa

SEQ ID NO: 15827 - DNA, 410 bp, Saccharomyces cerevisiae
atgttaaaatggcatcatcaatacagtattactgatgttatgttatttagtgctgtccgtatgtcctcctgttcttttttgggctacaatttaattgatggggtgttatgtttacgatatttcaattatgttaatatttagtatgtttatatcttctcattaatgaatagttaatttttacgtttaggtgattttggtggtgatttttctataatattgaaataagtgtatataaattgagtggttagtatatggtgaaaaagtggtataacgtatgtattaagagcatttatacggtatttgggcccgccgaatgagatatagatattaaaatgtggataatgatgggctttatgggtaaatggcacagggtatagaccgctgaggcaagtgccgttaatggtgatgtg

SEQ ID NO: 15828 - DNA, 471 bp, Saccharomyces cerevisiae
aaaagatgaatgtctctttgttaatttagctagagttttccttatttattttttttatttacactaattcaatctttttcgttatatttagatattattaaaaattattattatggaaaaaattcttaaaaggatagacagagggacgccgtctgctatatgatatgtatttaggtccgagtgctgataaactgtaaggcaaaaggtataagtgtaaatcaataacgtttctcgtattctttactctccttcaaattttttaaactagttcaacgtaatttgctgggaatataccttctctaccgttgactcttccggtccaccagtcattttgagaatctgattttttcaaaattgtgatcacgtcaccctttctgaatggtaaatctccggactcttctcctgcaaagctatataatgccacggcctttggagaagacgtggatggggatgttggagcagtgaatctgc

SEQ ID NO: 15829 - DNA, 458 bp, Saccharomyces cerevisiae
gcaaataagtgagatttttagctttttttttttagcatgtgtactatatagtatatggatttcttatttacaagcgcaataaaaagacgaacactaatccttgttgttccgcttcacgtccttacttgattctatttcattgtcttggtgaagtttctgtgtttccttcatcaattcatacagttgaactgtttgctcaggggatagtttctccagggtttccgaagataaagtggcatctttccatttaccgttggaaatcatgtggagataatcttgccaggaagctaaaaagccgactatatgcaacgggttatcgatatctttgtgcaacttgaactcgtttcgcacgtattggtcacccatctccctttggggaccaggtagcagcttatgctgccttagtatccttctgtagagaaccaaaggtggaagtaaaagctggctgttatgggttg

SEQ ID NO: 15830 - DNA, 469 bp, Saccharomyces cerevisiae
tttttccttttctgtttacatggtttcagaaagaacatttgtatatatacatacgtgcctatatatacatatttcctcaatccaagtaaaaaaaagtgcgatgtatcatggtcataagaatgttaaagggagttcttccctctatcaattattttataattttcttcaacatatttttgtttaagccggcattgttgtttttcttcttgtcattcattaaatgagagttgtaaattgaacttgaattaccactactactacttccattggaattagaaaccagtagcttcatcttttctgatatttcctttattagtaagctaaccgccacatcgacatttaaatcatccatgctgtctattccaacaaatccatatttccattttgttgctagttgtcttcccatttcaatcaacattgggcttgcgagttcatgattaacgtgagaacagacgataatgcatggtgg

SEQ ID NO: 15831 - DNA, 465 bp, Saccharomyces cerevisiae
cactattaatcaagcagaaagtaattgaaattattgtaaatcgaaatacctgtaatgtagcaaaacttttcgtggttgttacagcaactttttatacttaatatagcaagagtatccgtttttataaggcctacacaacggaatcctcttgatttccttttttctttgtaatttaccgacgcacgaatacgcgcgctgtcctttttcaaccatccatataaaccataaatggcccaagatagatgtgagtccctaaattgaaatcagttgaaaaacagaaggtataacaaaaccagatagacacctaataaagaacaaaatattcctatagttttgctgaacatagtttttattgaaagtttagaagaattacagcagagatttcgtcaccaacagaagaaaagctaaagcccaagcaatatggatgctgtaatactgaatctcttaggcgacattcctttggtc

SEQ ID NO: 15832 - DNA, 475 bp, Saccharomyces cerevisiae
tgcagtagctaaatgaccacagatgtatttatacattcatagctatatatatacatatatatatatacatgtaatatggcgcaagtaggcacggtagtcaccaattgctcaggtatctcctcggtgtaaaagcacgtacaccgcgttcggagagtcgtttataaactcaaaaggggaaagagacaagggtagccgaacgactggcaccggacacgaacacgaaaacttatttagattattaaaaaaaaaaaaaaaagagaggaaacgaggcggaggcggagaggaggagagagacaagagacgggcagaacaagaagggtaaaaacagtgagaaacagtctccgccgttttgactgcgtatccatcgttattgtccactacgagacgctaatgacgaaacgagctaccacatgcgtttcctacgcacctgctaaagacctgacactttaaaggacccatcttctggccttctgtc

SEQ ID NO: 15833 - DNA, 421 bp, Saccharomyces cerevisiae
gtcatcttatgtgtctcggttaaatatctgtttacgtatctatttatgtagcatgtcaggtccatttcttaaccaaagatgctttcaatcaggtaatgggtagttatttttttaatttatcggatacattgcggttgaatggcagactgccactatcttttaatatgacagaactattatcgttgggagattccatctcctcgttaatagcttcattcatgggcgagattggtgtgacaatttcttgtttatcttcgtcaataccgtccaaaaaacttccaagcagaagtgatttattgttagcaccatggtcaagccttatcatatctgatgaatattcatcttcttctgaaacggccttaaaatgattaattagttcctggaaatgtagtttactttggctaacggacctttgcgagat

SEQ ID NO: 15834 - DNA, 483 bp, Saccharomyces cerevisiae
atgattagtatatacctacacaattacaatatgtagatatatagtatggtagtaatgttacattttcgatttagactagccaacctgcgtatttacttggaatgcttacatgattatattgaatattacaaattttattatgtccatattaatccagagtcacggtgcaatggaaaaaggaaagggagaatgatagaataaaagaaggaaagaaagagacaatgtagcgaaggctagaaagtgatgtgaaaaaaaaaaccacaaaaaaaataaataagagatcagagggttaaatgaatgcgcttttaagaaattcaaatatctgtaaaggagaatccattcaatttcgaaacttgctcatttttccatgtaataaaatccttatcattttcatcttccatcatactggtatcatcaaatccgctttcaatatctttttgttgaatgtttaattgaaatttaccttctggcgacatggaaagt

SEQ ID NO: 15835 - DNA, 411 bp, Saccharomyces cerevisiae
gcttaagcgcaatcattgaatagtcaaagattttttttttttaattttttttttttaattttttttttttcatagacttttatttaaataaatcacgtctatatatgtatcagtatataacgtaaaaaaaaaaacaccgtcagttaaacaaaacataaataaaaaaaaaaagaagtgttcaaatcaaagtgtcaaatcaaaatttaaatgatgatgataatatgaccatacaatgacttaaatcaaatcaaaaccacttgcgtaaaggcagtgaatatggccaaaatataataccatacaccgttttgcatgttcgttaaacgaacaccattcgacaacgaggtggtcgaaggcgcagtagcagaaatgctcatcaattgagaagaataggtttcgttttctggaattgca

SEQ ID NO: 15836 - DNA, 471 bp, Saccharomyces cerevisiae
gaggcaactcacctatatcctcaaatcaaactctcgtttttgttctctttgttatctattctattgagagcatataagtacatatgttattagttgttatatatcgctacttaacatataaaatattttggagtcgtttatggtgtcccagaagatagcatttctattcatcgtgttgtgtcgtgacgtgtctcttgatatgcgcgacagaccatccaacgcaaggtcattaatcatgttatgttctgtaattttaaaggcattttttatagagtttcatcgaatttgtgatcgaactgttcattggtgatagatgaagagccatttaaatgaaaatccaacttaactcttaacttcagtttcccagatccagaaattttcaatgactgcttgcaaatttggctggcgtttattgtggaagatggatataactggcctagtgttagcttttgagctttaggaacggcacag

SEQ ID NO: 15837 - DNA, 447 bp, Saccharomyces cerevisiae
gcccaagagtaacgtgaaaaaaccggtttatttttgtttttactgttcgattgtgttacgtattctatgttttttgagatatatttgaaatatttttataagatacatatatatatgtgcgtattgctgcgacaaaagaagagacaaagagataggcgttgaaattgacgagacaaagaggaagacattaattaatcatcattttaaatgggatttttttacttgcaagcttttgacctgctcttctagtttttttacctttccttgaatttcttccaagtcaccgttcagtctgattctttcgttaacaatgttttgctcccattgtctaaatctttgctcctcagctttgacttggtcagtgaaatacttcttcaatgcattttcttcttctttgtatctaggattgtgtgacaatttccttgctggtgcaattgctggaagagt

SEQ ID NO: 15838 - DNA, 402 bp, Saccharomyces cerevisiae
ggatagaatggttcttttgctttttcaaatacattaatatgtatatatatgtatatataaatgtatgactgtgtaatgttacatatgcagaagtatccgatttttttttgattttttcttttatttcataaatccagttttttactgaaagataaacttaatcccttcaacagctgttgaggattaatcacttgtgagtggtcatcgtccgtttcgcttgagatctttctcattgtttctatgttcaatttattcacttttgaatttgttatttcgtttaaggctagtgagtgcgagtttaatatatgcgactggtaccttagctcatcgacttttgtttctaactttgtctcaacatctgcaatcgcaaggtctggctcttctgtatccgacaacggttcc

SEQ ID NO: 15839 - DNA, 433 bp, Saccharomyces cerevisiae
tcaagctaaattttgaggacttttaaaaaaagcgaaacatttaagtacttcattaaataataaatgatgctactatatagtgagtaaaccttattatatactatcaatgctaattcaataaagtatttaaagtatcaaccaatgcttaaaaagagtcaaaaaaaagggaaaaagaaataggaaagccaaacttatctcatgaaaacgttagacttgcaatccaatccaccagtgaccatcatttgccttggggtaacgttagaatcgaaatccacatccaggtctaaacagttgacaaatcctgtatgcaacttttcccaaacgtgtaagcactgccccgtgttcagatcccaacatctgacagatttatcatcagcacaagaaaacaagtattggcctcgaatactaatatctctaacccacgaaagatgcc

SEQ ID NO: 15840 - DNA, 463 bp, Saccharomyces cerevisiae
tttcccttgtgtgcctgcttcgctcagttgtttttgatatgtactttatacaaatatatataggaaaacaaattcttcaaagcgcgttaggaaaaagtatggaaaggcttagtttcatttattgacttacaagtggcacccaatttgattaatatgaaaaacaatctgcaaaaaaaaaaaaaaaattcaaaatatcacaatgttaaaacacaatagaaatagggcattgtattaaaaccactgaacgactaaaaattgaaaaagattatgatacgtcagctcaattattggtcaaggaaggcgtatctcatttacccctttcaagtttttgtaggcgcattattatcaatagtagtatcttcagaaacattaaaccatcaaaaagagacatgcgctctattgaaatcgtccaatattttcaatgttatttttgcatacaaagcgaaccaactgtggccatttt

SEQ ID NO: 15841 - DNA, 453 bp, Saccharomyces cerevisiae
attctctaacttaagatgaccagatgtcatgttcgtttacttattttcctctcctcttaccttttttggccactaacgctcgtacagaaatggacggcatacatacaatttaatcaattctcttaaataccgttttatacctcatttctgacttttcagccgttaatgttccttttttttttagactattgtatgtatcacttcctgaatgatgtcttccataacacaaacgtgacgtgcaaataaacatacataaaaatattattgaaaatacagattatttaaaattatataacccgttccctgtttattcagaagcagtagctctggtgtagatagcttgcttggagtgcttggagattggcttgatgataccttccttttccaagtgtctcaaagcaattctagctaaagaaccaccaatctttaatctgtcgaccaaaacagagacag

SEQ ID NO: 15842 - DNA, 406 bp, Saccharomyces cerevisiae
tcatctttgaaggcttgtgctgatcgaacgaagcaaatcctacgagtaaatacataagcgtatacatatatatatatatatatatatatatatatatatgtatatatatatatgtgtgtgtgtgtaattgtgtgtattcaactgaactatgaagagtctttgacctcttgagaatctcatagtatgaagatatggcacttctctttccgttgtaacatcctttaccgggcggcttttcggcctgcttgagaagagatcaggctgaaatgatgagactgacaacaaggatcagtcagtggcagagttgaaattccgctggaaatcgtcaccagcagctaccagctccaagaaatccgcgtagaaatcacgtcgcgcaatgtgcgatagtggtggaacagcgaaaatt

SEQ ID NO: 15843 - DNA, 402 bp, Saccharomyces cerevisiae
atcaaccaacggcttcttctcgcagctacagttgtattttactgtgacgtacttttgcgcgcgtacgggttcaatgaattacggattttcaacaacttcacacaatcatagctttttttactttttcgcctcattattttctttaaagaaacgatgataaacagagatttatcgtcatgttatttcgttcgtatatatcgtatttgcgttttagctgtataaagtaaaatactatatctaacgtggctttttttatttccccgtctgccctcttatgctcatagaaaacactaatgatcggtttggtatcgtcatagatgcagggtcttcgggttcgagaatccatgtgtttaagtggcaggacacggaatcgcttcttcatgcaacaaaccaggactcaca

SEQ ID NO: 15844 - DNA, 427 bp, Saccharomyces cerevisiae
tgaaccggtagatgaaaatgtatactttaaataatacaaatactttttttcttttttcttaaacccgataatacttttgtcgcttagataaagatgcagggaacttcaatcattgtggtgaccgcacaaaggcgggatctgaaaaatgatcgtatggggcgggggaagaatagaagagtgaacaaggggatatggtatccgtgcaagaaatgaatggccagaatagcttgatttttacttgctgaaaatgcagcaagcggaaacccctctatcagtaggcaaccaaagaaaacatggttttgtttatgatagtgttttctccgactaaatgacacttaatatataagccagtcatttttctttcatactttcctcttgcatgacgaaacaattctttttttatttcgtttccttgtctgtacttttt

SEQ ID NO: 15845 - DNA, 472 bp, Saccharomyces cerevisiae
acgatgattcagttcgccttctatcctttgtttacgtatttgtttatatatataactttatttttttttattaattgggctgcaagacaattttgttgtcagtgatgcctcaatccttcttttgcttccatatttaccatgtggaccctttcaaaacagagttgtatctctgcaggatgccctttttgacgtattgaatggcataattgcactgtcacttttcgcgctgtctcattttggtgcgatgatgaaacaaacatgaaacgtctgtaatttgaaacaaataacgtaattctcgggattggttttatttaaatgacaatgtaagagtggctttgtaaggtatgtgttgctcttaaaatatttggatacgacatcctttatcttttttcctttaagagcaggatataagccatcaagtttctgaaaatcaaaatggtagcaacaataatgcagacgacaacaactgtgc

SEQ ID NO: 15846 - DNA, 487 bp, Saccharomyces cerevisiae
ctgctattctaaaacgggtactgtacagttagtacattgagtcgaaatatacgaaattattgttcataattttcatcctggctctttttttcttcaaccatagttaaatggacagttcatatcttaactctaataatacttttctagttcttatccttttccgtctcaccgcagattttatcatagtattaaatttatattttgttcgtaaaaagaaaaatttgtgagcgttaccgctcgtttcattacccgaaggctgtttcagtagaccactgattaagtaagtagatgaaaaaatttcatcaccatgaaagagttcgatgagagctactttttcaaatgcttaacagctaaccgccattcaataatgttacgctctcttcattctgcggctacgttatctaacaagaggttttactctctcatatctcattcaaatagaaagaacataatcaaaaagcttctacgtcacccttctttcgatcca

SEQ ID NO: 15847 - DNA, 458 bp, Saccharomyces cerevisiae
aactaagctggttctaactggaaataatttccattagattcctctttttctcgtccattaaccaaaatatattattgaattcagcggttccttttttctcattttcgcatatagctgcactattagaatcagcccactctaggtaaacacagttcctcgatatacctctgtcttactatcagtggttaaaccttatgcaaatataatatatatatatatatatatatatatatctcatacttttgttgattcttgtgtaattattggaaaagacaaaacaaagcaagcgtttctattcatatttacaagtattttttatgacaaactatttcttaattttcccaccggcggctttgaataaggcaatgtcattgtcctgcataatatattgtttgcctgcacgtttgataagtcccttagattttagtaaagactcatttagcggtggttccatcttc

SEQ ID NO: 15848 - DNA, 446 bp, Saccharomyces cerevisiae
tcgtgaaataaaaaggtagtaagtacatctttataactaatataaaaaaagatacgtaccgatttgtgttaataatcattgttagtacatctttatacctctgtttctagctgaaggcggcgaattgaatagcagttctttttaaattggcagatacaataggattaatctcattgatacatttttgtagtctatttgtgtcgttctggaaacagttttgtaagcacgcccttaatgtggcctcggtgtccttttcaagtaaaggacccataaccttctgaaagaattccaaatccactataatttgtaatgagccatcattagaaagattaccaacataaggcttaaatgcctcaaagaggtatctggctataaaaatctgcgtttcaattaaaatcttatggatgagctgaggcccaattctaaagcactcactgtgaaccacg

SEQ ID NO: 15849 - DNA, 474 bp, Saccharomyces cerevisiae
gttttcctcatctataccggtcgactcaagcttggttttgagtatttctccctaatatttactgcaaatcttatatattgttcttgtatacgtggaagctagtctataaattatgcttttgaagaatttcctatctcgcattacgatcctagtatcttttgtccaatatgaagaaggtcaacatgaggatgggaatgataattgatagcatataatattattcttttgtcaatactagtgtttaggatatttctactaatacctaatacctcaatggtccaatactaaataaggtactattcattgtattgattgattctgcatttatctttctcttgaaccgtaaatatcattttcataagtcacatgataaaaacatatttaaaattttaaaaaaattaattttcaaaataaatttattatatttttttaattacataatcataaaaataaatgttcatgatttccgaacgt

SEQ ID NO: 15850 - DNA, 442 bp, Saccharomyces cerevisiae
aaatatgcgcacgtctatacacacaatactttttatgactagtatcattgtatactcttattatgtagggttatacatgagtgtttatacgttttctgtgtgtacatatatatccatatatgttaatgctaaatgcaagttttgtgatgctattcattagagatgcctttgtctaaaaatcaatgcttttatagtcatcataggttatgtcgtaaatggttttatccttaaattttaaggagattttggatgaaatgtttatgtcagctctggtaaagccttttgaaaaagtacatttatcattttttgggaaattagtggaagaagaagaatgctttttcttaatgcatggtaaacaaggtgtgagcaaaaccaacttatcaatatgcttaatcaacttgcgtgagcctgtaccctcaatgacatcatccggtatggcaat

SEQ ID NO: 15851 - DNA, 482 bp, Saccharomyces cerevisiae
tgagcgcgctacattacagttaatgcctccagcaacctgtagtgcttctttaaaccgatccgatacagctgaaacaaacattgattttactaattttcatataatatatacacatatatcgaatgataatgcaaaatataatttaatgaaattggaaatactcggaaaatttatcattatccttttcttcttttgaacgtaaacttcggaccgtcgtcatcgtcgtcgtcgccatcaccgttattagaagccccaaaagagccacgtgatctactagttgcgcttctactgtgtctactttgcttggaacattcttctgacaagtttggccgtaagttcatttccttcaccacaaaaagattacgattattttctctgtgatttagtctatcgcttttatcatcaatatcacccagatcatcttcatcagtaataaaaattttgttttttagtggttgaacgctggctgcagtacctgaaca

SEQ ID NO: 15852 - DNA, 440 bp, Saccharomyces cerevisiae
tactgtcctatatatacttttttgtcatgggtacacatacatgtacgacatatatatatatatatatatatatattagcgagtttacattgatgtagagcagtaactggaagaaataaaaatttaaacttaatactagggggtccgtcttctcgtgggtacttcttttacagttttcaacttctgctgacttgtatgccttcttggcgcttcttcggaaaagttgacagcgggctttactttaacggcaaatcgcagtaagtaagcaagtaacgaactcgcacttcagcaaaataaaaaagaacaatcgattagaaattcaaatttcaccgtgactctttaacccctgccgaatattataagcaaactatgataacactcttattatacctgtgcgtaatatgtaacgcaatagtgttaataagggctgattcgatagcg

SEQ ID NO: 15853 - DNA, 432 bp, Saccharomyces cerevisiae
gagatattttgcagcagttgcgcacttgcatgtgaatgactcttctcccctttaattctgtgctatatttttacaattttctgctgacatatagtttatatacatatagaacgcatataggaaattgaagtaaacagaatacacaagtagaggccggtatgtacgacattttgcttactactctttaaaatcatcgtcttcttcgtcttcatcgtcttcttctttttcaccatatcctacatcatctttagagcctgtgctaggttccttcttgtctaattcttctgcagtctttttatagtcaattactttgccgcgtgttcttcttccggatgtgatgatattagaggtatcaatttctgccaaatcgtcctcttcttcttctccctcatttcccatcaatgcgtctaacttggcatcgtccatatcaga

SEQ ID NO: 15854 - DNA, 466 bp, Saccharomyces cerevisiae
aaataagctttgaaataaacgactttactatatacaggtatatgaagtatctctaactaaaacttttatctatctttcattcttattatatctcatctcgtacgaagggccgctcattggatcatttttctttacataccgtaaaggaatggcgttaaaaatatatatatgaaaatgcatgtaataaactctctgcagaaaccttaatgtcaaaggtcccgtatacagattatattggctctgcgtatacgcattctcgtcatggtgaaggataatcgagattctgaccaagaccaagattttagttctgctcacatgaaaagacaaccggagcagcaacagttgcaacagcaccagttcccaagtaagaaacaacgaatatctcaccatgatgacagtcatcaaatcaaccatagaccagttacctcatgtacacattgtagacagcacaaaatcaaatgcgatg

SEQ ID NO: 15855 - DNA, 404 bp, Saccharomyces cerevisiae
atttagctttgatctgtagcctaagtataaaattctacgtatgtatatatttacatgcaattttttctttttccaattcatgttaatgttcttcatcatttgataataggccaatgatattatctactatcttctccttttgaggagaagctgctttcacttcctcgttgcttttctcttcgtataaatacatgaatttcgacttgtccagcatttttttatcaatacaatgcatgtgcccatgaagttctacctccgacaaatctttaacaaaatatgtcgttatttgtgtcatgaatttcagtagggtttgaaatatttcgggtatggcgttcttcttatccagaataacaattttgtagtttgctgataatgttattggacgaagctggatgggcctattt

SEQ ID NO: 15856 - DNA, 409 bp, Saccharomyces cerevisiae
gattctaaacgcatagttgtaaggttgatgtatatatatatatatatatgtatatattaattacaataatatgctcccgcccaaatttttctccttcaataccgccggaggcggtattgaaggaaatagacggagaattccttatcaagaaagcttccatcaaagtgtacataagaagtgccgaaattcgaagtattctttcagagagtatttttgcaacataccaataagccaaattactcatggaaggtggcgaagaagaagttgagcgcattcctgatgaacttttcgatacaaaaaagaagcatttgttagataagctcataagggtcggaataatccttgtactcctgatatggggcactgttttgttgctaaaaagtatacctcaccattcaaacacaccaga

SEQ ID NO: 15857 - DNA, 450 bp, Saccharomyces cerevisiae
tataaatgctagcgtactgcctgtatatcgctgcacataatatgtatctataatttatattaacgtacataacttttaggtatgttaccatcaaagcgtgtccgagttattgagattttgacaaattcagacaaatcatttttgaagaaccatatatataaatatataaagaaaagaaaggtaaaccaaagacagcaaacaatcgaaaagtggacaaccagcaatggtagattcaattcaccgtattgcatcggcgttggatacggccaaagtaataacgagggaagctgccgcggtagccacctctaagctgggtgaatcctcctatacttattattctcaaaacatcaatcctcaacagttagtcaccttgttaaattctaggaactctagagaagttagagatgcaatgaagagaataatatctataatggcttccgatgatgactc

SEQ ID NO: 15858 - DNA, 437 bp, Saccharomyces cerevisiae
taggacttgctcagttatatttcatttctatttcataagctagaaggctaacttgtataaagctgcgcagaaagtgtttccattttacgtatatttagatttatattttgccttaggtgctttttgaatttcaaatggtttagtgttgatctttttcaaaaattaatctttttagatcgcagatacctctgatacaagttttatacttaagtatcgaagaccagcaccgtggttaaaaatcttaacatgatccggttaccgaggctgtatcaaaggtacctattatacttggtagtttttgtagtgattgccctattttacttcctacaggcgccaagagttgaagagcacattggtttcgaccttgcactcccgatatcacacgttgataatctatggttccaaaataaaggtctagagggattctcaaatgacga

SEQ ID NO: 15859 - DNA, 423 bp, Saccharomyces cerevisiae
ctataaacgtccgttgtagtgaacttaagtattataccatacatatatacccttcgtattaatttttcctttttattgttgggctgtgtgtatataatttatgtacaagaatggatatatcaaaaaatccttaaaagatgtaaatcaaaaacatcaatcaacacagcttattttgtagagctttgtttttgacataacttttcaagcttgttgattttttctaaaacaattttatccctttcaccatctaaatatttctcatctgtttgataaaacaggaggcacgatttcatttcatctcgttgcttatcacaagtgggaaaaactttcattccatttgccttagcacaatctgccattgcttgaacaaaatttgcacattttttgtatgtttccgtcttcaagttcttgcgagcctgttgt

SEQ ID NO: 15860 - DNA, 481 bp, Saccharomyces cerevisiae
ttaggctaatatgaatgtatttgatctctattttattaatacgaaaccccttaataattgatattttcgatacatatttggcagtagttagctacgtaacagagtattattttcatttcaagttatgcatgaactctctaatttcacataccatgctaccactacccttggaggttttgttcatatcttttataataaagctaaaaccgaaaaggtgaagggaaaaaaaaactattagagcctgtttcttgtatatagtagtatgtaatatttgcttcgtacgcttagttcatcccaatagtaattcataaacaatcaccagtatatttattccaattaatggtactacaagaataatatacgaaacgttagtaaaattttctcacaaaaggtgaaaaagaacgggaaaaaactgatgaaatgtaactttaaccgttctccatcaacataacatactcctcagtaatgtctgtacggcgcc

SEQ ID NO: 15861 - DNA, 462 bp, Saccharomyces cerevisiae
tttagtttgtttatcatcgatagtctatataatgttcgttgttacttattttatttagtttctcaagtgactattgtgaatccgtaataattcaccacataaatacagtgaaccgcatacaacaattggccgtctttgctcgtctgatacatgcgccagagaaggcaatacctgatgtaaatcattttcaatcactatctcctttgtgtatccttgagtcaaaataaaatcttttatttcttcaggatcagtggcatgaatccagggcataccttccacattattaaaccgagtaagaattacttgatctataggcctcaataatggctggagcagcggctccaagtttttcccatgcgttactgccatcacaaaggtcaaaggctggtttccgtactcctttcttaggtacttaactaactctactgcagctgagccattgtgggcaccgtccattaatat

SEQ ID NO: 15862 - DNA, 500 bp, Saccharomyces cerevisiae
tctcgagaaaaacaaaagagttaataataaagtatatatgcttttttactattaataaagtttcttattttccctacatgtatacatacatataaatatactcttttggaaaaaatttcttttttttttttttaatttttttatatttttccatcttttgatgtaatatagaggttatataatgaaagaatatataagaggtcataaaaaatcattaaaaaaatgcgagttcaggaacatattatcgtttacgtaatcagtgcgttattggcggattagtaccgatcacacctttgttcatcgatgtggatgcagtttgctttgctgcgacggctgcaggagtctccccttttattatgtagtgaataacctgtttaaaagaatcaccgttccgtatcctaaagttagcaattcttgttagatggtagcctgcagtgcaacccaggaaaaaattgacggaagctaacagatagttcttgggcttgatgacaaacgaccaa

SEQ ID NO: 15863 - DNA, 481 bp, Saccharomyces cerevisiae
ggaaagctttttaaaacactatgcaatcatctatgtaaatatatatatatatatatattataccggcggtagtaagcagtatttttttctatcagtctatattatttgtttctttttcttgtctgttttctcatgttaccttcttagcattaccataatgcgaatcttctgatgatgtgtcggataacccaatagaatcagtcgtcgtcgcacctagcgaagcagtttcaatggaatcttcttcttcaagaattgttggtataccaccaaacgttcttttgccgcgctgaacagatttaaattgcactttcttttctcctgcttcattttcgttgtctgaaatagatgacttggtctttgtcttttgaagagccattctttctccaaattcctcatcatcatcgttattgtatgagaagtcactcaggtccgatgttcttcttgctctatttctcttcttccaaccaggccttctaaacca

SEQ ID NO: 15864 - DNA, 435 bp, Saccharomyces cerevisiae
aggccaccatttgaatatacacagtatatatatatatgtatgtatgcatatttcaaataacttgtttagctttcatcctttcgaatacctccttcaataaaaaaaaaaagaaaaatcttgttaaattataaagtgttcattctatttttttgaattgtaaaataacaaaataaatattcgattgaactgccatggaaaaggttctaccctctaacacgagtacccgtgcttcttgttcctataatttactgttttatcacttcattatttcttttcaacgcccggtaagttatccaaagacactacaccattagcaataagctgcggatccacaagcttgtctctatgctcataaagtatcttgtaaccagatttgatggtaccttcagtaacttgcaaggtttggcccactttcgctgcggtaatagggatctg

SEQ ID NO: 15865 - DNA, 413 bp, Saccharomyces cerevisiae
ttttgagtgatattattggtttacacaatatgtaaatgttttataacaatagaaagtactttgtaacaggtattacgaacattactatctaatctccactgtatttctcctttatatgtttgtcttgatttcgtgaaatagtttgtgaacatttttttgatctttttttcgtaaagaagggcccttttcaaatttatttacattttggtcatttgaaaatactttacttaaaaagacgaggaagaaactgtaaatccatagttcgagagttgaagtgcccttcaaaacaaaaactcctgactttttttgctcatttttagtcaatgaactaaaactcaccttccttctcgtttatttttgcctagcattatagagcaattataactatatattaaagttgacgcaccgaaaaa

SEQ ID NO: 15866 - DNA, 493 bp, Saccharomyces cerevisiae
aaggacttgtaagaagttttgttagaaaataaatcattttttaattgagcattcttattcctattttatttaaatagttttatgtattgttagctacatacaacagtttaaatcaaattttctttttcccaagtccaaaatggaggtttattttgatgacccgcatgcgattatgttttgaaagtataagactacatacatgtacatatatttaaacatgtaaacccgtccattatattgcttactttcttcttttttgccgttttgacttggacctctggtttgctatttccttacaatctttgctacaataccatttgcccttgggagcttgtttcaggcctacgcaaccataatggaaccactcgaagggacaagccggattatcacaagccaccattggcccataagatacattcctacagaaacaataaacctcctcttgattattattaccctctgttacatcaccctggttaatcccaattgtggg

SEQ ID NO: 15867 - DNA, 481 bp, Saccharomyces cerevisiae
acataatgtttttaatgctgatttcctataatattaggccttcttttgtgaaaaggagtatatttatataactgaataaaaatatatattgtgacaaatgcccatgcaaaaaatcgtgaaaaaaggaagaaagttctactattctatgtaaaaataaacccattagatttttttcctctttgtgtaatgctcactaccgcgattatcgttcgtttcatctggacatgccaacgttcttgaccttttagaacttacgaccggatgaatactgtcatcatcacatgcaagtaagtttttggtcataaagtcgatagcattgtagtcatgtgtccttttgttaacgttattattgttgagagtagataacatactagactttcctatgctgctgttagtataagggttcttgctgttgtcttgtgcgtgaaaggtgtggctttgagcattgtaagaggacataaattcattgacactgccacca

SEQ ID NO: 15868 - DNA, 439 bp, Saccharomyces cerevisiae
cctgcaactcctcaatgtgtcaattaactcttacttaatttatgtatatattttttatgtatatgcttatatgcatgcgcatatgctcataaaagatacattgttataggtcatttcttttccaagctacatctagcactccttccaaccatggtccaggacagccaggaccttttcttgccaaaattcttgctttcccatctcagagaaaaaacgaggaatttttctttgtcctctttggccgccagttgcggtaaaatattttttttctaggtcgcatagtttgaaagacttgtctttttcaccacccaagaaaaatatatttagtgaagagatgtaaagcccattctcacgtatttcaagaaattaggcatcgcttcggtagacacattcaaaccatttttccctcatcggcacattaaagctggatgaccatccc

SEQ ID NO: 15869 - DNA, 429 bp, Saccharomyces cerevisiae
gaaccactttgttcttctttcctccttataattttctgaacctcttcagtttttgtatacgaacgttttccatgtatccatacatttaaatagtaagtatgtaaattggtatgtggtgttttgaattgcgatgttgcctatatacaagattgtacgctatctgaatacatactctttaccaatcaaatgtcaagaccggggatcttaacctcttcgatagtaatcccagaatccaataatcccttcttttcctcttttggcttctcttctttcttgtggccaaaaacagattctttacgtaactccatgttcttttgaacttccgtttcatggcgtttagagagctgttgatggtcttcctctagctttgcctcaagtgtttggtattgttttaacagttccgtatttatgtcgtgttcttcgctgagt

SEQ ID NO: 15870 - DNA, 417 bp, Saccharomyces cerevisiae
tattgttcgttttttatcatagtttttcaaatcttcatatgaatactaggtagaaatttggcttatcagtacgaatgaattacagtttgactgatttgtacacgagaattgacgtataacttcttttgaaagtctttgaaattacatggtagtacatacatatatatatatatatatatatgttatattattgttaattaaatattattatgcgtattttccttttctttattagtatagtattaatgacagtaataataataataatagtaacaatatctctttttttttttcagtgagcttttatttttttttcattgctcttcttttggcctcttttgtttttttcttgatttcctccagtttcatctgttttttctttggatcagatacaaaatctggtttgaacgcgtcata

SEQ ID NO: 15871 - DNA, 426 bp, Saccharomyces cerevisiae
acacttctcgattaacaaattcccagtattctttgaaatctatttttcttcctcaattgaatttgaataactgtctacgcggactcctcctatctacaactacaacaaattttaaccactttattaccactttcctctttcatttatttttgtcttttatgttgtcaatttactagtatttttttttttttcatttacgttcaaggttttttatactcatttaacttgtcttaggttatttatatatatacctatatatttatatatatatatatatatgtatgtatatattattatcaccaaatgagaaataatagctaatttgatttttgattatttaaaatattggtttgttctttctgcaaacatctcgtttggtacgatattagtgaaaaacgatgtaattatcaacacgtgcattaccca

SEQ ID NO: 15872 - DNA, 429 bp, Saccharomyces cerevisiae
taagctggttgatggaaaatataattttattgggcaaacttttgtttatctgatgtgttttatactattatctttttaattaatgattctatatacaaacctgtatattttttctttaaccaatttttttttttatagacctagagctgtacttttattctgctatcaagcaaacccctaccccctcttctcaatcctcccctcaggcagaacttatctacctgtatcaaggagcggacgagggagtcctaattgttctacgtataccaatgctagcagcttacataggtggtggcactaccataatacttatatataatatctttacgctcaagtaaatttctccgccgcataaattaacaccatgttctttttagtcgcaccttattttcttgtattttttttctttccttttcttcccgtttttcc

SEQ ID NO: 15873 - DNA, 455 bp, Saccharomyces cerevisiae
gcggattgagagcaaatcgttaagttcaggtcaagtaaaaattgatttcgaaaactaatttctcttatacaatcctttgattggaccgtcatcctttcgaatataagattttgttaagaatattttagacagagatctactttatatttaatatctagatattacataatttcctctctaataaaatatcattaataaaataaaaatgaagcgatttgattttgtgttgtcaacttagtttgccgctatgcctcttgggtaatgctattattgaatcgaagggctttattatattaccctttagcttattctgaggtttctgtggcgtgcaaagtgatgaaccgggcgggttttaaggataaaatcaaaaagtgaaaaaatgaacggaaaatggaatacctgtgaaatggagaatgataatgaatctttctgtcgtgcttgaaagattttcggct

SEQ ID NO: 15874 - DNA, 496 bp, Saccharomyces cerevisiae
ataaacaattttcttgttttccttcattttacaaaatctggtgtaaatcctcgattccattgtgatttaaaaataattaattactgtataagattctatatagacaattaattgaaaatagtattacttctttaactcgcttaggattttttttattttttctctcttttccggagaattgccaaatgttttcacggcctcttccaataatagcttcatttcttccaacgcaactactagtttcccattgtaagtggcgaagtactcgctgatatcatcatcttcagaagcttctttaatggaagttgttaaagaatttatagaatttgtttggctcagaatatctgataatttactttcgcctatttggagagcctgacatttcagtattaaatctttccttaaattactatactcgcttagaactttgagatcattttccacttcaacttcctcttcgtctgctacttccatctgcggcagcttcaacacatct

SEQ ID NO: 15875 - DNA, 407 bp, Saccharomyces cerevisiae
gataaggaactgtaacagagtgccatatatatatatatagattggaacatatataatatatacgctatttagtttagtcacctaaacgcaccgtttccatatttcgtgctggacgattttcgactcgataatacgtataagatcggtactaatagtaacaaaagtaaaggtaatacttgcttcaactgtacaaaggagcatagaacgtggggcaatttacaagcgatgtcgacgtcagtcccagtcaagaaggcattaagtgctcttttacgcgatccaggaaacagtcattgtgccgactgtaaggcgcaactacatccacgctgggcttcctggtcacttggtgttttcatttgcattaaatgtgctggtatacatagatcattgggaacgcacatttcgaaagt

SEQ ID NO: 15876 - DNA, 416 bp, Saccharomyces cerevisiae
agccagtttattcttgccatccgtgtacgctaggagaggattattaaaataagtgatatatacatatatatatatatatatatatatataatacactaattattttatgtgatgttgatcacgcgaaacggtaaacggctctgttcgcgctttctttgtttacattttagtgaagtattgtcaagataatatccatatggttgaactttttatattggctagttaaatactctatttattgcaccaaaaaatcatcttagtggactttttggagcaaaaaaaaccagcaggtagttatataagatgactacacaactaaggtatgaaaataacgatgacgatgaaagagtagaatataatctctttaccaatagatccaccatgatggcaaattttgaagaatggatcaaaatggc

SEQ ID NO: 15877 - DNA, 408 bp, Saccharomyces cerevisiae
taaagcgtgtatgtgtaggcataccgtttttattatcagctacgatcgaaatatatacgtttttatctatgttacgttatatattgtagtcttaaccatttgtaagttttgcttcttttcttttattcatttcataacatcatactgttttacgtaataccatccttaactttttccaccgaaggggaggaagaactaaattctagaaaaatgaaaccattaaaaaaaaagaaaacaatagagctgcttctacaattttgcacatcaaaaaagacctccaactaccgagtttgtaagtacaatgtctcaacccactcccatcataactacaaaatcagctgctaagccaaaaccaaaaatttttaatttattccgcgtttgcttcatttcattattgctgatcgctgc

SEQ ID NO: 15878 - DNA, 434 bp, Saccharomyces cerevisiae
taaagtaagagcgctacattggtctacctttttgttcttttacttaaacattagttagttcgttttctttttctcatttttttatgtttcccccccaaagttctgattttataatattttatttcacacaattccatttaacagagggggaatagattctttagcttagaaaattagtgatcaatatatatttgcctttcttttcatcttttcagtgatattaatggtttcgagacactgcaatggccctagttgtctaagaggatagatgttactgtcaaagatgatattttgaatttcaattgacgtaattaatgatactattaataatacagagcgtatatgaagtattgcaaataacatgcacagttcttttgggatgagaatgataatgaaaggcgaaggcgggcgttcagaaaagcgttgcggagtaa

SEQ ID NO: 15879 - DNA, 499 bp, Saccharomyces cerevisiae
gaagcttatttgcagattgaaggttgcagctatacaaaatctatcttatatatttgtgccttttgtttcttatatatgtcttctttaaatagtacatcactataatacaataatactaataactctattgtaactcgtgatatattcactaattatttaggtgcgaaaaaccatacccgcattgatatactttttgggtatattgagttcttccgcgttagttgttatgggccttctatggtagacaagaattttatatacgtaggcctaacattagtggctccagctgcttaccaaatccatgaccgatgagaaacgagcttttccaaaaggtaacaaccatataagatcagaaactttcaatggttcggtatctcacaaaatctccgaatcgattaaagatatcgctagcttaagaccacacggtaaatatacggtacaagacatcgacaacatcatagcatccacatcttcacatgaaaatagaggccaatcaggc

SEQ ID NO: 15880 - DNA, 500 bp, Saccharomyces cerevisiae
agcctgatcagtgacttttcatcacactgtgtttttatatagttcttagtagtaaatatactctataatttctacatccttttcatgatgtgccagttaagctatttttagcaaacaaaaagatgaatttgagtattgagcacatcattcactgttcagctgatacaaaacatatgatttctaatattcacataggaaaaatcgctccaaacatcgaagtatcatcgctactttggtcttttatctgcttctcttctcttcgctcttttcactgctcgtgccgctgcaacgctccaactcagttctatctcagctccttccccttatcccttgagcagtgtcaaggcgaggctgcgtgatgtattcgtgcgcgaaaaaaaaaacaactgcagcacctgagtttcgcgtatggtcacccactacactactcggtcaggctcttaccagcttaactacagttgatcggacgggaaacggtgctttctggtagatatggccgc

SEQ ID NO: 15881 - DNA, 462 bp, Saccharomyces cerevisiae
tcgaatttacgtagcccaatctaccacttttttttttcattttttaaagtgttatacttagttatgctctaggataatgaactacttttttttttttttttttactgttatcataaatatatataccttattgttgtttgcaaccgtcggttaattccttatcaaggttccccaagttcggatcattaccatcaatttccaacattttcatgagttcttcttcttcattaccgtgttttagggggctgttcgcacttctaatagggctatcaccaagctgttctaattcgtccaaaagttcagtaacacgatctttatgctttagctcgtcataatctttcaattcataaatatttacaatttcgtctacgatattaaattgcctcttgtaggtgcctatcttttccttatgctcttcattttcaccgttttcttgaaaccaaacaccgaactcactacgca

SEQ ID NO: 15882 - DNA, 402 bp, Saccharomyces cerevisiae
gtctactcaattgtaaaaaaaaacaaaaaaaatcttgatttaaaaaacgatacccaatatttttaactttaaattaaggctttgataatcttctttttctctgttatatcaaaggactgctttctggtttgccttcgctaatctttttttttttttttcattttcctattttagttcgtttatgatctcatttgtatttctgtatatttgtcttaatacgaaatacgagtttttattttatattctacctttcttttttttttggctaaaagcgtgtacggttctatgtaaatatgtacgattacatgtgtaatgtttgtttggccgggctcttcatctatgccgttgccttcttgcaggcggagtcctggatctgttacgatggtttctcgatcctcttgg

SEQ ID NO: 15883 - DNA, 446 bp, Saccharomyces cerevisiae
gaggacggttgctgaagaaaaaggctttttttattttgtccgttttttttttgtaaaacccaaagatctgaatctaaagcttttttaaacgtatatagatgtctacatgtgtgtttttgtttttttacgtacgtatacccacctatatatgcataatccgtaattgaaaaaaaaaaaagaaaaagatcaaggaacacatcaccctgggcacatcaagcgtgaggaatgccgtccaactggtggagacgcttgatttgctctttttgttctgggtccaacccggtctcgaagaacatcagcaccacgcccgcaacgacaaagaacattgcaatacacttgcatatgtgagcatagtcgagcggtccgttctgtggttgatgctgttgttctttcttctgtttgtcaggggtgatagccatatcttcgtgctcttgttgcgattgttc

SEQ ID NO: 15884 - DNA, 433 bp, Saccharomyces cerevisiae
tctagcacaaggttcctacgtcatcccttcctgttcttacatctggcgtccagagcaaacataaaatattagaaactctaattgttatacatatatatgtttatatctgtttatggtacgttcttttctttaattttgctttttgaaaagtgatgttcgcaatctatctcactaattggttaagaacagtagttagttcgtcaggggtatatttgatatgctttctaggattcttgaaagagtctttatatctactgtagaatctttcatacatgggcataaccaacgatattatttctgacttcaaagttactttcaatgatggatctgaaagcttatactgttttgtttttgatactaaatcttcgaatccttcattgaattttctaaatttctcctttatttgttctttgtcttttgacttcttcccgct

SEQ ID NO: 15885 - DNA, 423 bp, Saccharomyces cerevisiae
atttcttaacagatggctgaaaaattttttttttttttttggttttgctttgtatacacatgtatctatttttataaagatgaaatatatacgtctaagagctaaaatgaaaaactatactaatcacttatatctattctggtgattcatcatcttcagcttctgtatccgtatcgatatcagtataatcgctagcatcactttcatcatcactttcggtttcgtcgtcatcagtagagtactcatcatcctcctcagaatacacctctacttgttccactgcaggagaatcacgaactttcatattcatggtaatatccaaatctgtagtgaaataatctgtggatttaacgattactctaaaaaagaaatcaccaacagtttcaggtgcaggctgacctaatggaatttttatggtcccga

SEQ ID NO: 15886 - DNA, 21 bp, Artificial
  primer
gaattgtataactgaggtacc

SEQ ID NO: 15887 - DNA, 21 bp, Artificial
  primer
atcagttattacccgggtacc

SEQ ID NO: 15888 - DNA, 49 bp, Artificial
  primer
ccgctgctggcattacccatggtatggatgaattgtataactgaggtac

SEQ ID NO: 15889 - DNA, 49 bp, Artificial
  primer
ctcacaaattagagcttcaatttaattatatcagttattacccgggtac

SEQ ID NO: 15890 - DNA, 40 bp, Artificial
  primer
cataaacaaacaaagagctcatggtctccgttatcaaacc

SEQ ID NO: 15891 - DNA, 41 bp, Artificial
  primer
gaaaaggggcctgtggtaccttatgaatgggcgacagcatc

SEQ ID NO: 15892 - DNA, 49 bp, Artificial
  primer
tgtatctgcacctagatcgaattcacaagcgcgcctctaccttgcagac

SEQ ID NO: 15893 - DNA, 49 bp, Artificial
  primer
cacctttagaagccatgagctctgttaattcagtaaattttcgatcttg

SEQ ID NO: 15894 - DNA, 40 bp, Artificial
  primer
tggatgaactgtacaactgaggtacctaagctggttgatg

SEQ ID NO: 15895 - DNA, 31 bp, Artificial
  primer
gcttcctatattatatatatagtaatgtcgt

SEQ ID NO: 15896 - DNA, 47 bp, Artificial
  primer
tggatgaactgtacaactgaggtaccgaattgaattgaaatcgatag

SEQ ID NO: 15897 - DNA, 31 bp, Artificial; identical to SEQ ID NO: 15895
  primer
